United States Patent 12,569,549 (FLAVIVIRUS VACCINE) - sequence listing, part 2

SEQ ID NO: 1383 - RNA, 2037 nt, synthetic construct
  misc_feature 1..2037: note = derived and/or modified CDS sequence (opt1) from DENV-3 Consensus__SSopt-prME(Y96H)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacccacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1384 - RNA, 2037 nt, synthetic construct
  misc_feature 1..2037: note = derived and/or modified CDS sequence (opt1) from DENV-3 Consensus__SSopt-prME(K110E)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcggggagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1385 - RNA, 2037 nt, synthetic construct
  misc_feature 1..2037: note = derived and/or modified CDS sequence (opt1) from DENV-3 Consensus__SSopt-prME(H149N)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagaaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1386 - RNA, 2037 nt, synthetic construct
  misc_feature 1..2037: note = derived and/or modified CDS sequence (opt1) from DENV-3 Consensus__SSopt-prME(S184F)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgcttcccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1387 - RNA, 2037 nt, synthetic construct
  misc_feature 1..2037: note = derived and/or modified CDS sequence (opt1) from DENV-3 Consensus__SSopt-prME(R186L)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1388 - RNA, 2037 nt, synthetic construct
  misc_feature 1..2037: note = derived and/or modified CDS sequence (opt1) from DENV-3 Consensus__SSopt-prME(N240S)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagagcgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1389 - RNA, 2037 nt, synthetic construct
  misc_feature 1..2037: note = derived and/or modified CDS sequence (opt1) from DENV-3 Consensus__SSopt-prME(M258L)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgctgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1390 - RNA, 2037 nt, synthetic construct
  misc_feature 1..2037: note = derived and/or modified CDS sequence (opt1) from DENV-3 Consensus__SSopt-prME(H259N)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgaacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1391 - RNA, 2037 nt, synthetic construct
  misc_feature 1..2037: note = derived and/or modified CDS sequence (opt1) from DENV-3 Consensus__SSopt-prME(H259R)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcgcacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1392 - RNA, 2037 nt, synthetic construct
  misc_feature 1..2037: note = derived and/or modified CDS sequence (opt1) from DENV-3 Consensus__SSopt-prME(A265T)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1393 - RNA, 2037 nt, synthetic construct
  misc_feature 1..2037: note = derived and/or modified CDS sequence (opt1) from DENV-3 Consensus__SSopt-prME(S296G)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgggctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1394 - RNA, 2037 nt, synthetic construct
  misc_feature 1..2037: note = derived and/or modified CDS sequence (opt1) from DENV-3 Consensus__SSopt-prME(S311R)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtccgcgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1395 - RNA, 2037 nt, synthetic construct
  misc_feature 1..2037: note = derived and/or modified CDS sequence (opt1) from DENV-3 Consensus__SSopt-prME(K321T)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaccgtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1396 - RNA, 2037 nt, synthetic construct
  misc_feature 1..2037: note = derived and/or modified CDS sequence (opt1) from DENV-3 Consensus__SSopt-prME(G28C,H242C)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcactgcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcctgcgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1397 - RNA, 2037 nt, synthetic construct
  misc_feature 1..2037: note = derived and/or modified CDS sequence (opt1) from DENV-3 Consensus__SSopt-prME(R186L,A265T)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1398 - RNA, 2037 nt, synthetic construct
  misc_feature 1..2037: note = derived and/or modified CDS sequence (opt1) from DENV-3 Consensus__SSopt-pr(D104A)ME(F108S)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1399 - RNA, 2037 nt, synthetic construct
  misc_feature 1..2037: note = derived and/or modified CDS sequence (opt1) from DENV-3 Consensus__SSopt-pr(D104A)ME(R186L,A265T)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1400 - RNA, 2037 nt, synthetic construct
  misc_feature 1..2037: note = derived and/or modified CDS sequence (opt1) from DENV-3 Consensus__SSopt-pr(D104A)ME(F108S,R186L,A265T)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1401 - RNA, 2016 nt, synthetic construct
  misc_feature 1..2016: note = derived and/or modified CDS sequence (opt1) from DENV-3 Consensus__SSopt-prMEdel101-107,(R99P,F108N)
  source 1..2016: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccccgggaacgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1402 - RNA, 2037 nt, synthetic construct
  misc_feature 1..2037: note = derived and/or modified CDS sequence (opt1) from DENV-3 Consensus__SSopt-prMEdelstem_TM-JEV
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1403 - RNA, 2037 nt, synthetic construct
  misc_feature 1..2037: note = derived and/or modified CDS sequence (opt1) from DENV-3 Consensus__SSopt-pr(D104A)MEdelstem_TM,(F108S)-JEV
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1404 - RNA, 2037 nt, synthetic construct
  misc_feature 1..2037: note = derived and/or modified CDS sequence (opt1) from DENV-3 Consensus__SSopt-pr(D104A)MEdelstem_TM,(R186L,A265T)-JEV
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1405 - RNA, 2037 nt, synthetic construct
  misc_feature 1..2037: note = derived and/or modified CDS sequence (opt1) from DENV-3 Consensus__SSopt-pr(D104A)MEdelstem_TM,(F108S,R186L,A265T)- JEV
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1406 - RNA, 2037 nt, synthetic construct
  misc_feature 1..2037: note = derived and/or modified CDS sequence (opt1) from DENV-3 Consensus__SSopt-prMEdelstem_TM,(H259N)-JEV
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgaacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1407 - RNA, 2037 nt, synthetic construct
  misc_feature 1..2037: note = derived and/or modified CDS sequence (opt1) from DENV-3 Consensus__SSopt-prMEdelstem_TM,(R186L,A265T)-JEV
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1408 - RNA, 2016 nt, synthetic construct
  misc_feature 1..2016: note = derived and/or modified CDS sequence (opt1) from DENV-3 Consensus__SSopt-prMEdelstem_TM,del101-107,(R99P,F108N)-JEV
  source 1..2016: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccccgggaacgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1409 - RNA, 3081 nt, synthetic construct
  misc_feature 1..3081: note = derived and/or modified CDS sequence (opt1) from DENV-3 Consensus__SSc-prME-NS1
  source 1..3081: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtga

SEQ ID NO: 1410 - RNA, 1824 nt, synthetic construct
  misc_feature 1..1824: note = derived and/or modified CDS sequence (opt1) from DENV-3 Consensus__SSm-EdelTM-linker-ferritin
  source 1..1824: mol_type = other RNA
atgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccagcggcggggacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 1411 - RNA, 1821 nt, synthetic construct
  misc_feature 1..1821: note = derived and/or modified CDS sequence (opt1) from DENV-3 Consensus__SStPA-WHbcAg-linker-EdelTM
  source 1..1821: mol_type = other RNA
atggacgccatgaagcgcggcctgtgctgcgtgctcctgctgtgcggggccgtcttcgtggacagcgtgaccggcatggacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtgcgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgcggcgggggcgggagcggcgggggcggcatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctga

SEQ ID NO: 1412 - RNA, 5505 nt, synthetic construct
  misc_feature 1..5505: note = derived and/or modified CDS sequence (opt1) from DENV-3 Consensus__SSc-prME-NS1-[IRES]-NS3
  source 1..5505: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtga

SEQ ID NO: 1413 - RNA, 5505 nt, synthetic construct
  misc_feature 1..5505: note = derived and/or modified CDS sequence (opt1) from DENV-3 Consensus__NS3-[IRES]- SSc-prME-NS1
  source 1..5505: mol_type = other RNA
atgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtga

SEQ ID NO: 1414 - RNA, 4248 nt, synthetic construct
  misc_feature 1..4248: note = derived and/or modified CDS sequence (opt1) from DENV-3 Consensus__SSm-EdelTM-linker-ferritin-[IRES]-NS3
  source 1..4248: mol_type = other RNA
atgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccagcggcggggacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtga

SEQ ID NO: 1415 - RNA, 4245 nt, synthetic construct
  misc_feature 1..4245: note = derived and/or modified CDS sequence (opt1) from DENV-3 Consensus__SStPA-WHbcAg-linker-EdelTM-[IRES]-NS3
  source 1..4245: mol_type = other RNA
atggacgccatgaagcgcggcctgtgctgcgtgctcctgctgtgcggggccgtcttcgtggacagcgtgaccggcatggacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtgcgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgcggcgggggcgggagcggcgggggcggcatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtga

SEQ ID NO: 1416 - RNA, 75 nt, synthetic construct; identical to SEQ ID NO: 1260
  misc_feature 1..75: note = derived and/or modified CDS sequence (opt1) from Homo sapiens__SigSeq(TPA)/SStPA
  source 1..75: mol_type = other RNA

SEQ ID NO: 1417 - RNA, 489 nt, synthetic construct
  misc_feature 1..489: note = derived and/or modified CDS sequence (opt1) from Helicobacter pylori J99__Ferritin
  source 1..489: mol_type = other RNA
gacatcatcaagctgctcaacgagcaggtcaacaaggagatgcagagctccaacctgtacatgagcatgtccagctggtgctacacccactccctggacggcgccggcctcttcctgttcgaccacgccgcggaggagtacgagcacgccaagaagctgatcatcttcctcaacgagaacaacgtgcccgtgcagctgaccagcatctccgccccggagcacaagttcgaggggctgacgcagatcttccagaaggcctacgagcacgagcagcacatcagcgagtccatcaacaacatcgtggaccacgccatcaagagcaaggaccacgcgaccttcaacttcctccagtggtacgtcgccgagcagcacgaggaggaggtgctgttcaaggacatcctggacaagatcgagctcatcgggaacgagaaccacggcctgtacctggccgaccagtacgtgaaggggatcgccaagtcccgcaagagc

SEQ ID NO: 1418 - RNA, 450 nt, synthetic construct
  misc_feature 1..450: note = derived and/or modified CDS sequence (opt1) from Woodchuck hepatitis virus__WHbcAg
  source 1..450: mol_type = other RNA
atggacatcgacccctacaaggagttcggcagctcctaccagctgctcaacttcctgccgctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtgaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgcccatcctctccaccctgcccgagcacaccgtgatctgc

SEQ ID NO: 1419 - RNA, 303 nt, synthetic construct
  misc_feature 1..303: note = derived and/or modified CDS sequence (opt1) from Japanese encephalitis virus__Cterm-JEV/JEV
  source 1..303: mol_type = other RNA
ggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggcgtgaacgcccgggaccgctccatcgccctggccttcctcgcgaccgggggcgtcctggtgttcctggccacgaacgtgcacgcc

SEQ ID NO: 1420 - RNA, 15 nt, synthetic construct
  misc_feature 1..15: note = derived and/or modified CDS sequence (opt1) from Artificial__MKRKK
  source 1..15: mol_type = other RNA
atgaagcgcaagaag

SEQ ID NO: 1421 - skipped

SEQ ID NO: 1422 - RNA, 27 nt, synthetic construct
  misc_feature 1..27: note = derived and/or modified CDS sequence (opt1) from Artificial__Linker(G4SG4)
  source 1..27: mol_type = other RNA
ggcgggggcgggagcggcgggggcggc

SEQ ID NO: 1423 - RNA, 51 nt, synthetic construct; identical to SEQ ID NO: 1267
  misc_feature 1..51: note = derived and/or modified CDS sequence (opt1) from Foot-and-mouth disease virus__F2A/P2A
  source 1..51: mol_type = other RNA

SEQ ID NO: 1424 - RNA, 300 nt, synthetic construct
  misc_feature 1..300: note = derived and/or modified CDS sequence (opt1) from DENV-1 CYD23__C
  source 1..300: mol_type = other RNA
atgaacaaccagcgcaagaagaccgcccggcccagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaag

SEQ ID NO: 1425 - RNA, 342 nt, synthetic construct
  misc_feature 1..342: note = derived and/or modified CDS sequence (opt1) from DENV-1 CYD23__C-SSc
  source 1..342: mol_type = other RNA
atgaacaaccagcgcaagaagaccgcccggcccagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaagtccgtcaccatgctcctgatgctgatgcccaccgccctcgcc

SEQ ID NO: 1426 - RNA, 273 nt, synthetic construct
  misc_feature 1..273: note = derived and/or modified CDS sequence (opt1) from DENV-1 CYD23__pr
  source 1..273: mol_type = other RNA
ttccacctgaccacccgcggcggggagccccacatgatcgtgagcaagcaggagcggggcaagtccctcctgttcaagacgagcgccggggtcaacatgtgcaccctgatcgccatggacctcggcgagctgtgcgaggacaccatgacctacaagtgcccgcgcatcacggaggcggagcccgacgacgtggactgctggtgcaacgccaccgacacctgggtgacctacgggacgtgctcccagaccggcgagcaccggcgcgacaagcgg

SEQ ID NO: 1427 - RNA, 225 nt, synthetic construct
  misc_feature 1..225: note = derived and/or modified CDS sequence (opt1) from DENV-1 CYD23__M
  source 1..225: mol_type = other RNA
agcgtggccctggcgccccacgtcggcctcgggctggagacccgcaccgagacgtggatgtccagcgagggcgcctggaagcagatccagcgggtggagacctgggccctgcgccacccggggttcaccgtgatcgccctcttcctggcccacgccatcggcacctccatcacgcagaaggggatcatcttcatcctgctcatgctggtcacccccagcatggcg

SEQ ID NO: 1428 - RNA, 498 nt, synthetic construct
  misc_feature 1..498: note = derived and/or modified CDS sequence (opt1) from DENV-1 CYD23__prM
  source 1..498: mol_type = other RNA
ttccacctgaccacccgcggcggggagccccacatgatcgtgagcaagcaggagcggggcaagtccctcctgttcaagacgagcgccggggtcaacatgtgcaccctgatcgccatggacctcggcgagctgtgcgaggacaccatgacctacaagtgcccgcgcatcacggaggcggagcccgacgacgtggactgctggtgcaacgccaccgacacctgggtgacctacgggacgtgctcccagaccggcgagcaccggcgcgacaagcggagcgtcgccctggcgccccacgtgggcctcgggctggagacccgcaccgagacgtggatgtccagcgagggcgcctggaagcagatccagcgggtggagacctgggccctgcgccaccccgggttcaccgtcatcgccctcttcctggcccacgccatcggcacctccatcacgcagaaggggatcatcttcatcctgctcatgctggtgaccccgagcatggcg

SEQ ID NO: 1429 - RNA, 1485 nt, synthetic construct
  misc_feature 1..1485: note = derived and/or modified CDS sequence (opt1) from DENV-1 CYD23__E
  source 1..1485: mol_type = other RNA
atgcgctgcgtgggcatcgggagccgggacttcgtcgagggcctgtccggggccacctgggtggacgtggtcctcgagcacggcagctgcgtgaccacgatggccaaggacaagcccaccctggacatcgagctgctcaagaccgaggtgaccaacccggcggtcctgcgcaagctgtgcatcgaggccaagatctccaacacgaccaccgacagccggtgccccacccagggggaggccacgctcgtggaggagcaggacgccaacttcgtgtgccgccggaccttcgtcgaccgcggctggggcaacgggtgcggcctgttcgggaagggctccctgatcacgtgcgccaagttcaagtgcgtgaccaagctcgaggggaagatcgtgcagtacgagaacctgaagtacagcgtcatcgtgaccgtgcacaccggcgaccagcaccaggtcggcaacgagtccaccgagcacgggaccacggcgaccatcacgccccaggcccccaccaccgagatccagctgaccgactacggcgccctcaccctggactgcagcccgcggaccgggctggacttcaacgagatggtgctcctgacgatgaaggagaagtcctggctggtgcacaagcagtggttcctcgacctgcccctgccctggaccagcggcgcctccaccagccaggagacctggaaccgccaggacctcctggtcacgttcaagaccgcgcacgccaagaagcaggaggtggtggtcctgggctcccaggagggggccatgcacaccgccctcaccggcgccacggagatccagaccagcgggaccaccacgatcttcgcgggccacctgaagtgccggctgaagatggacaagctcaccctgaaggggatgtcctacgtgatgtgcaccggcagcttcaagctggagaaggaggtggccgagacccagcacggcaccgtcctcgtgcagatcaagtacgaggggacggacgccccctgcaagatcccgttctccacccaggacgagaagggcgtcacccagaacgggcgcctgatcaccgccaaccccatcgtgacggacaaggagaagcccgtgaacatcgaggccgagcccccgttcggcgagagctacatcgtcatcggggcgggcgagaaggccctgaagctctcctggttcaagaagggcagcagcatcgggaagatgttcgaggccaccgcccggggcgcccgccggatggcgatcctgggggacaccgcctgggacttcggctccatcgggggcgtgttcaccagcgtgggcaagctggtccaccagatcttcgggacggcctacggcgtcctcttctccggggtgagctggaccatgaagatcggcatcggcgtgctgctgacctggctcgggctgaactcccgcagcacctccctgagcatgacgtgcatcgccgtgggcctcgtgaccctgtacctgggggtcatggtgcaggcc

SEQ ID NO: 1430 - RNA, 1983 nt, synthetic construct
  misc_feature 1..1983: note = derived and/or modified CDS sequence (opt1) from DENV-1 CYD23__prME
  source 1..1983: mol_type = other RNA
ttccacctgaccacccgcggcggggagccccacatgatcgtgagcaagcaggagcggggcaagtccctcctgttcaagacgagcgccggggtcaacatgtgcaccctgatcgccatggacctcggcgagctgtgcgaggacaccatgacctacaagtgcccccgcatcacggaggcggagcccgacgacgtggactgctggtgcaacgccaccgacacctgggtgacctacgggacgtgctcccagaccggcgagcaccggcgcgacaagcggagcgtcgccctggcgccccacgtgggcctcgggctggagacccgcaccgagacgtggatgtccagcgagggcgcctggaagcagatccagcgggtggagacctgggccctgcgccaccccgggttcaccgtcatcgccctcttcctggcccacgccatcggcacctccatcacgcagaaggggatcatcttcatcctgctcatgctggtgaccccgagcatggcgatgcggtgcgtgggcatcggctcccgcgacttcgtcgaggggctgagcggcgccacctgggtggacgtggtcctcgagcacgggtcctgcgtgaccacgatggccaaggacaagcccaccctggacatcgagctgctcaagaccgaggtgaccaaccccgccgtcctgcggaagctgtgcatcgaggccaagatcagcaacacgaccaccgactcccgctgccccacccagggcgaggcgacgctcgtggaggagcaggacgccaacttcgtgtgccggcgcaccttcgtcgaccggggctgggggaacggctgcgggctgttcggcaaggggagcctgatcacgtgcgccaagttcaagtgcgtgaccaagctcgagggcaagatcgtgcagtacgagaacctgaagtactccgtcatcgtgaccgtgcacaccggcgaccagcaccaggtcgggaacgagagcaccgagcacggcaccacggccaccatcaccccgcaggcccccaccaccgagatccagctgacggactacggggcgctcaccctggactgcagcccccgcaccggcctggacttcaacgagatggtgctcctgaccatgaaggagaagtcctggctggtccacaagcagtggttcctcgacctgcccctgccgtggacgtccggggccagcaccagccaggagacctggaaccggcaggacctcctggtgaccttcaagacggcccacgccaagaagcaggaggtggtcgtgctgggctcccaggagggcgccatgcacaccgcgctcaccggggccaccgagatccagacgagcggcaccaccaccatcttcgccgggcacctgaagtgccgcctgaagatggacaagctcacgctgaagggcatgtcctacgtgatgtgcaccgggagcttcaagctggagaaggaggtcgccgagacccagcacggcaccgtgctcgtgcagatcaagtacgagggcacggacgccccctgcaagatccccttctccacccaggacgagaagggggtcacccagaacggccggctgatcaccgcgaaccccatcgtgacggacaaggagaagccggtgaacatcgaggccgagccgcccttcggggagagctacatcgtcatcggcgccggcgagaaggccctgaagctctcctggttcaagaaggggagctccatcggcaagatgttcgaggcgaccgcccgcggggcccggcgcatggccatcctgggcgacaccgcctgggacttcgggagcatcggcggcgtgttcacctccgtggggaagctggtccaccagatcttcggcacggcgtacggggtgctgttcagcggcgtgtcctggaccatgaagatcgggatcggcgtcctcctgacctggctgggcctcaacagccgctccaccagcctgtccatgacgtgcatcgccgtggggctggtgaccctctacctgggcgtcatggtgcaggcc

SEQ ID NO: 1431 - RNA, 2025 nt, synthetic construct
  misc_feature 1..2025: note = derived and/or modified CDS sequence (opt1) from DENV-1 CYD23__SSc-prME
  source 1..2025: mol_type = other RNA
agcgtgaccatgctgctcatgctgatgcccaccgccctggccttccacctcacgacccgcggcggggagccccacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccaccaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtggggctcgtcaccctgtacctgggcgtgatggtgcaggcc

SEQ ID NO: 1432 - RNA, 2325 nt, synthetic construct
  misc_feature 1..2325: note = derived and/or modified CDS sequence (opt1) from DENV-1 CYD23__C-prME
  source 1..2325: mol_type = other RNA
atgaacaaccagcgcaagaagaccgcccggcccagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaagtccgtcaccatgctcctgatgctgatgcccaccgccctcgccttccacctgaccacgcgcggcggggagccccacatgatcgtgagcaagcaggagcggggcaagtccctcctcttcaagaccagcgcgggggtgaacatgtgcaccctgatcgccatggacctgggcgagctctgcgaggacaccatgacgtacaagtgcccccgcatcaccgaggccgagcccgacgacgtcgactgctggtgcaacgccaccgacacctgggtgacgtacgggacctgctcccagaccggcgagcaccggcgcgacaagcggagcgtggccctggcgccccacgtcggcctggggctcgagacccgcacggagacctggatgtccagcgagggcgcctggaagcagatccagcgggtggagacctgggccctgcgccacccggggttcaccgtgatcgccctgttcctcgcccacgcgatcggcacgtccatcacccagaagggcatcatcttcatcctgctgatgctcgtcacccccagcatggccatgcggtgcgtggggatcggctcccgcgacttcgtggaggggctgagcggcgccacctgggtcgacgtggtgctggagcacgggtcctgcgtcacgaccatggccaaggacaagcccaccctcgacatcgagctgctgaagaccgaggtgacgaaccccgccgtgctccgcaagctgtgcatcgaggcgaagatcagcaacaccaccaccgacagccggtgcccgacgcagggcgaggccaccctggtcgaggagcaggacgccaacttcgtgtgccgccggaccttcgtggaccgcggctgggggaacggctgcgggctgttcggcaaggggtccctgatcacgtgcgccaagttcaagtgcgtcaccaagctggagggcaagatcgtgcagtacgagaacctcaagtacagcgtcatcgtgaccgtgcacaccggcgaccagcaccaggtcgggaacgagtccaccgagcacggcaccacggccaccatcacgccccaggcgcccaccaccgagatccagctgaccgactacggggccctgaccctcgactgcagcccccggaccggcctggacttcaacgagatggtgctgctcacgatgaaggagaagtcctggctggtgcacaagcagtggttcctggacctcccgctgccctggaccagcggggcctccaccagccaggagacctggaaccgccaggacctgctggtcacgttcaagaccgcccacgcgaagaagcaggaggtggtggtcctcggctcccaggagggcgccatgcacaccgccctgaccggggccacggagatccagaccagcggcaccaccacgatcttcgccgggcacctgaagtgccggctcaagatggacaagctgaccctgaagggcatgtcctacgtgatgtgcaccggcagcttcaagctcgagaaggaggtggcggagacccagcacgggacggtcctggtgcagatcaagtacgagggcaccgacgccccctgcaagatccccttctccacccaggacgagaagggggtgacccagaacggccgcctgatcacggccaacccgatcgtcaccgacaaggagaagcccgtgaacatcgaggccgagccgcccttcggggagagctacatcgtgatcggcgccggcgagaaggcgctcaagctgtcctggttcaagaaggggagctccatcggcaagatgttcgaggccaccgcccgcggggcccggcggatggccatcctgggcgacaccgcgtgggacttcgggagcatcggcggcgtcttcacgtccgtggggaagctcgtgcaccagatcttcggcaccgcctacggggtcctgttcagcggcgtgagctggaccatgaagatcgggatcggcgtgctgctcacctggctgggcctgaactcccgcagcacgtccctcagcatgacctgcatcgccgtcgggctggtgaccctgtacctcggcgtgatggtccaggcc

SEQ ID NO: 1433 - RNA, 45 nt, synthetic construct; identical to SEQ ID NO: 1277
  misc_feature 1..45: note = derived and/or modified CDS sequence (opt1) from DENV-1 CYD23__SSc
  source 1..45: mol_type = other RNA

SEQ ID NO: 1434 - RNA, 57 nt, synthetic construct; identical to SEQ ID NO: 1278
  misc_feature 1..57: note = derived and/or modified CDS sequence (opt1) from DENV-1 CYD23__SSopt
  source 1..57: mol_type = other RNA

SEQ ID NO: 1435 - RNA, 57 nt, synthetic construct
  misc_feature 1..57: note = derived and/or modified CDS sequence (opt1) from DENV-1 CYD23__SSm
  source 1..57: mol_type = other RNA
atgacccagaagggcatcatcttcatcctgctcatgctggtgacccccagcatggcc

SEQ ID NO: 1436 - RNA, 1488 nt, synthetic construct
  misc_feature 1..1488: note = derived and/or modified CDS sequence (opt1) from DENV-1 CYD23__E
  source 1..1488: mol_type = other RNA
atgcgctgcgtgggcatcgggagccgggacttcgtcgagggcctgtccggggccacctgggtggacgtggtcctcgagcacggcagctgcgtgaccacgatggccaaggacaagcccaccctggacatcgagctgctcaagaccgaggtgaccaacccggcggtcctgcgcaagctgtgcatcgaggccaagatctccaacacgaccaccgacagccggtgccccacccagggggaggccacgctcgtggaggagcaggacgccaacttcgtgtgccgccggaccttcgtcgaccgcggctggggcaacgggtgcggcctgttcgggaagggctccctgatcacgtgcgccaagttcaagtgcgtgaccaagctcgaggggaagatcgtgcagtacgagaacctgaagtacagcgtcatcgtgaccgtgcacaccggcgaccagcaccaggtcggcaacgagtccaccgagcacgggaccacggcgaccatcacgccccaggcccccaccaccgagatccagctgaccgactacggcgccctcaccctggactgcagcccgcggaccgggctggacttcaacgagatggtgctcctgacgatgaaggagaagtcctggctggtgcacaagcagtggttcctcgacctgcccctgccctggaccagcggcgcctccaccagccaggagacctggaaccgccaggacctcctggtcacgttcaagaccgcgcacgccaagaagcaggaggtggtggtcctgggctcccaggagggggccatgcacaccgccctcaccggcgccacggagatccagaccagcgggaccaccacgatcttcgcgggccacctgaagtgccggctgaagatggacaagctcaccctgaaggggatgtcctacgtgatgtgcaccggcagcttcaagctggagaaggaggtggccgagacccagcacggcaccgtcctcgtgcagatcaagtacgaggggacggacgccccctgcaagatcccgttctccacccaggacgagaagggcgtcacccagaacgggcgcctgatcaccgccaaccccatcgtgacggacaaggagaagcccgtgaacatcgaggccgagcccccgttcggcgagagctacatcgtcatcggggcgggcgagaaggccctgaagctctcctggttcaagaagggcagcagcatcgggaagatgttcgaggccaccgcccggggcgcccgccggatggcgatcctgggggacaccgcctgggacttcggctccatcgggggcgtgttcaccagcgtgggcaagctggtccaccagatcttcgggacggcctacggcgtcctcttctccggggtgagctggaccatgaagatcggcatcggcgtgctgctgacctggctcgggctgaactcccgcagcacctccctgagcatgacgtgcatcgccgtgggcctcgtgaccctgtacctgggggtcatggtgcaggcctga

SEQ ID NO: 1437 - RNA, 1182 nt, synthetic construct
  misc_feature 1..1182: note = derived and/or modified CDS sequence (opt1) from DENV-1 CYD23__EdelTM-variant (aa1-394)
  source 1..1182: mol_type = other RNA
atgcgctgcgtgggcatcgggagccgggacttcgtcgagggcctgtccggggccacctgggtggacgtggtcctcgagcacggcagctgcgtgaccacgatggccaaggacaagcccaccctggacatcgagctgctcaagaccgaggtgaccaacccggcggtcctgcgcaagctgtgcatcgaggccaagatctccaacacgaccaccgacagccggtgccccacccagggggaggccacgctcgtggaggagcaggacgccaacttcgtgtgccgccggaccttcgtcgaccgcggctggggcaacgggtgcggcctgttcgggaagggctccctgatcacgtgcgccaagttcaagtgcgtgaccaagctcgaggggaagatcgtgcagtacgagaacctgaagtacagcgtcatcgtgaccgtgcacaccggcgaccagcaccaggtcggcaacgagtccaccgagcacgggaccacggcgaccatcacgccccaggcccccaccaccgagatccagctgaccgactacggcgccctcaccctggactgcagcccgcggaccgggctggacttcaacgagatggtgctcctgacgatgaaggagaagtcctggctggtgcacaagcagtggttcctcgacctgcccctgccctggaccagcggcgcctccaccagccaggagacctggaaccgccaggacctcctggtcacgttcaagaccgcgcacgccaagaagcaggaggtggtggtcctgggctcccaggagggggccatgcacaccgccctcaccggcgccacggagatccagaccagcgggaccaccacgatcttcgcgggccacctgaagtgccggctgaagatggacaagctcaccctgaaggggatgtcctacgtgatgtgcaccggcagcttcaagctggagaaggaggtggccgagacccagcacggcaccgtcctcgtgcagatcaagtacgaggggacggacgccccctgcaagatcccgttctccacccaggacgagaagggcgtcacccagaacgggcgcctgatcaccgccaaccccatcgtgacggacaaggagaagcccgtgaacatcgaggccgagcccccgttcggcgagagctacatcgtcatcggggcgggcgagaaggccctgaagctctcctggttcaagaag

SEQ ID NO: 1438 - RNA, 1275 nt, synthetic construct
  misc_feature 1..1275: note = derived and/or modified CDS sequence (opt1) from DENV-1 CYD23__EdelTM-variant (aa1-424)
  source 1..1275: mol_type = other RNA
atgcgctgcgtgggcatcgggagccgggacttcgtcgagggcctgtccggggccacctgggtggacgtggtcctcgagcacggcagctgcgtgaccacgatggccaaggacaagcccaccctggacatcgagctgctcaagaccgaggtgaccaacccggcggtcctgcgcaagctgtgcatcgaggccaagatctccaacacgaccaccgacagccggtgccccacccagggggaggccacgctcgtggaggagcaggacgccaacttcgtgtgccgccggaccttcgtcgaccgcggctggggcaacgggtgcggcctgttcgggaagggctccctgatcacgtgcgccaagttcaagtgcgtgaccaagctcgaggggaagatcgtgcagtacgagaacctgaagtacagcgtcatcgtgaccgtgcacaccggcgaccagcaccaggtcggcaacgagtccaccgagcacgggaccacggcgaccatcacgccccaggcccccaccaccgagatccagctgaccgactacggcgccctcaccctggactgcagcccgcggaccgggctggacttcaacgagatggtgctcctgacgatgaaggagaagtcctggctggtgcacaagcagtggttcctcgacctgcccctgccctggaccagcggcgcctccaccagccaggagacctggaaccgccaggacctcctggtcacgttcaagaccgcgcacgccaagaagcaggaggtggtggtcctgggctcccaggagggggccatgcacaccgccctcaccggcgccacggagatccagaccagcgggaccaccacgatcttcgcgggccacctgaagtgccggctgaagatggacaagctcaccctgaaggggatgtcctacgtgatgtgcaccggcagcttcaagctggagaaggaggtggccgagacccagcacggcaccgtcctcgtgcagatcaagtacgaggggacggacgccccctgcaagatcccgttctccacccaggacgagaagggcgtcacccagaacgggcgcctgatcaccgccaaccccatcgtgacggacaaggagaagcccgtgaacatcgaggccgagcccccgttcggcgagagctacatcgtcatcggggcgggcgagaaggccctgaagctctcctggttcaagaagggcagcagcatcgggaagatgttcgaggccaccgcccggggcgcccgccggatggcgatcctgggggacaccgcctgggacttcggctcctga

SEQ ID NO: 1439 - RNA, 1266 nt, synthetic construct
  misc_feature 1..1266: note = derived and/or modified CDS sequence (opt1) from DENV-1 CYD23__EdelTM-variant (aa1-421)
  source 1..1266: mol_type = other RNA
atgcgctgcgtgggcatcgggagccgggacttcgtcgagggcctgtccggggccacctgggtggacgtggtcctcgagcacggcagctgcgtgaccacgatggccaaggacaagcccaccctggacatcgagctgctcaagaccgaggtgaccaacccggcggtcctgcgcaagctgtgcatcgaggccaagatctccaacacgaccaccgacagccggtgccccacccagggggaggccacgctcgtggaggagcaggacgccaacttcgtgtgccgccggaccttcgtcgaccgcggctggggcaacgggtgcggcctgttcgggaagggctccctgatcacgtgcgccaagttcaagtgcgtgaccaagctcgaggggaagatcgtgcagtacgagaacctgaagtacagcgtcatcgtgaccgtgcacaccggcgaccagcaccaggtcggcaacgagtccaccgagcacgggaccacggcgaccatcacgccccaggcccccaccaccgagatccagctgaccgactacggcgccctcaccctggactgcagcccgcggaccgggctggacttcaacgagatggtgctcctgacgatgaaggagaagtcctggctggtgcacaagcagtggttcctcgacctgcccctgccctggaccagcggcgcctccaccagccaggagacctggaaccgccaggacctcctggtcacgttcaagaccgcgcacgccaagaagcaggaggtggtggtcctgggctcccaggagggggccatgcacaccgccctcaccggcgccacggagatccagaccagcgggaccaccacgatcttcgcgggccacctgaagtgccggctgaagatggacaagctcaccctgaaggggatgtcctacgtgatgtgcaccggcagcttcaagctggagaaggaggtggccgagacccagcacggcaccgtcctcgtgcagatcaagtacgaggggacggacgccccctgcaagatcccgttctccacccaggacgagaagggcgtcacccagaacgggcgcctgatcaccgccaaccccatcgtgacggacaaggagaagcccgtgaacatcgaggccgagcccccgttcggcgagagctacatcgtcatcggggcgggcgagaaggccctgaagctctcctggttcaagaagggcagcagcatcgggaagatgttcgaggccaccgcccggggcgcccgccggatggcgatcctgggggacaccgcctgggactga

SEQ ID NO: 1440 - RNA, 2031 nt, synthetic construct
  misc_feature 1..2031: note = derived and/or modified CDS sequence (opt1) from DENV-1 CYD23__SSc-prME
  source 1..2031: mol_type = other RNA
atgagcgtgaccatgctgctcatgctgatgcccaccgccctggccttccacctcacgacccgcggcggggagccccacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccaccaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtgagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1441 - RNA, 2031 nt, synthetic construct
  misc_feature 1..2031: note = derived and/or modified CDS sequence (opt1) from DENV-1 CYD23__SSc-prME(F108S)
  source 1..2031: mol_type = other RNA
atgagcgtgaccatgctgctcatgctgatgcccaccgccctggccttccacctcacgacccgcggcggggagccccacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgtccggcaaggggagcctcatcacgtgcgccaagttcaagtgcgtgaccaagctggagggcaagatcgtccagtacgagaacctgaagtactccgtgatcgtgaccgtccacaccggcgaccagcaccaggtggggaacgagagcacggagcacggcaccaccgcgaccatcacgccccaggcccccaccaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggcctccaccagccaggagacgtggaaccggcaggacctgctggtgaccttcaagaccgcccacgcgaagaagcaggaggtcgtggtgctcggctcccaggagggcgccatgcacaccgccctgacgggggccaccgagatccagaccagcggcaccacgaccatcttcgccgggcacctgaagtgccgcctcaagatggacaagctgaccctgaagggcatgtcctacgtcatgtgcaccgggagcttcaagctcgagaaggaggtggcggagacgcagcacggcaccgtgctggtccagatcaagtacgagggcaccgacgccccctgcaagatccccttctccacccaggacgagaagggggtgacgcagaacggccggctgatcaccgccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacacggcctgggacttcgggagcatcggcggcgtgttcacctccgtcgggaagctggtgcaccagatcttcggcaccgcctacggggtcctcttcagcggcgtgtcctggaccatgaagatcgggatcggcgtgctgctgacgtggctcggcctgaacagccgctccaccagcctgtccatgacctgcatcgccgtggggctcgtcaccctgtacctgggcgtgatggtgcaggcctga

SEQ ID NO: 1442 - RNA, 2031 nt, synthetic construct
  misc_feature 1..2031: note = derived and/or modified CDS sequence (opt1) from DENV-1 CYD23__SSc-prMEdelstem_TM-JEV
  source 1..2031: mol_type = other RNA
atgagcgtgaccatgctgctcatgctgatgcccaccgccctggccttccacctcacgacccgcggcggggagccccacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccaccaccgagatccagctcaccgactacggggccctgaccctggactgcagcccccgcacgggcctcgacttcaacgagatggtcctgctgaccatgaaggagaagtcctggctcgtgcacaagcagtggttcctggacctgccgctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccaccctgggcaaggccttcagcacgaccctgaagggggcccagcgcctcgccgcgctgggcgacaccgcctgggacttcgggtccatcggcggcgtgttcaacagcatcgggcgggccgtccaccaggtgttcggcggggccttccgcaccctgttcggcgggatgtcctggatcacgcagggcctcatgggcgccctgctgctctggatgggggtgaacgcgcgcgaccggagcatcgccctggccttcctggccaccggcggggtcctcgtgttcctggccaccaacgtgcacgcgtga

SEQ ID NO: 1443 - RNA, 2379 nt, synthetic construct
  misc_feature 1..2379: note = derived and/or modified CDS sequence (opt1) from DENV-1 CYD23__C-P2A-SSc-prME
  source 1..2379: mol_type = other RNA
atgaacaaccagcgcaagaagaccgcccggcccagcttcaacatgctgaagcgcgcccggaaccgcgtgtccaccgtcagccagctcgcgaagcggttctccaagggcctgctgagcgggcagggcccgatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaagaacttcgacctcctgaagctggccggcgacgtcgagtccaaccccgggcccagcgtgaccatgctcctgatgctgatgcccaccgccctcgcgttccacctgaccacgcgcggcggggagccccacatgatcgtgtccaagcaggagcggggcaagagcctcctcttcaagacctccgccggggtcaacatgtgcaccctgatcgccatggacctgggcgagctctgcgaggacaccatgacgtacaagtgcccccgcatcaccgaggccgagccggacgacgtggactgctggtgcaacgccaccgacacctgggtgacgtacgggacctgcagccagaccggggagcaccggcgcgacaagcggtccgtcgcgctggcgccccacgtgggcctggggctcgagacccgcacggagacctggatgagctccgagggcgcctggaagcagatccagcgggtggagacctgggccctgcgccaccccggcttcaccgtcatcgccctgttcctcgcccacgccatcgggacgagcatcacccagaagggcatcatcttcatcctgctgatgctcgtgaccccctccatggccatgcggtgcgtggggatcggcagccgcgacttcgtcgaggggctgtccggcgccacctgggtggacgtggtcctggagcacggcagctgcgtgacgaccatggccaaggacaagccgaccctcgacatcgagctgctgaagaccgaggtgacgaaccccgcggtcctccgcaagctgtgcatcgaggccaagatcagcaacaccaccaccgactcccggtgccccacgcagggggaggccaccctggtggaggagcaggacgccaacttcgtgtgccgccggaccttcgtcgaccgcggctgggggaacggctgcgggctgttcggcaagggcagcctgctgacctgcgccaagttcaagtgcgtgacgaagctcgaggggaagatcgtccagtacgagaacctgaagtactccgtgatcgtgaccgtccacaccggcgaccagcaccaggtggggaacgagagcaccgagcacggcaccacggcgaccatcacgccccaggccccgaccaccgagatccagctgaccgactacggggccctcaccctggactgcagcccccggaccggcctggacttcaacgagatggtgctcctgacgatgaaggagaagtcctggctggtccacaagcagtggttcctggacctccccctgccctggacctccggcgccagcacctcccaggagacctggaaccgccaggacctgctcgtgacgttcaagaccgcgcacgccaagaagcaggaggtggtcgtgctggggagccaggagggcgccatgcacaccgccctgaccggggccacggagatccagacctccggcaccaccacgatcttcgcgggccacctcaagtgccggctgaagatggacaagctgaccctcaaggggatgagctacgtgatgtgcaccggctccttcaagctggagaaggaggtcgccgagacccagcacgggacggtgctggtgcagatcaagtacgagggcaccgacgccccgtgcaagatccccttcagcacccaggacgagaagggggtcacccagaacggccgcctcatcacggccaaccccatcgtgaccgacaaggagaagcccgtgaacatcgaggccgagccgcccttcggcgagtcctacatcgtcatcggggcgggcgagaaggccctgaagctgagctggttcaagaaggggtccagcatcggcaagatgttcgaggccaccgcccggggcgcccgccggatggcgatcctcggcgacaccgcctgggacttcggctccatcgggggcgtgttcacgagcgtggggaagctggtccaccagatcttcggcaccgcctacggggtgctgttcagcggcgtgtcctggaccatgaagatcggcatcggggtcctcctgacctggctgggcctcaacagccgctccacgagcctgtccatgacctgcatcgccgtggggctggtgaccctctacctgggcgtcatggtgcaggcgtga

SEQ ID NO: 1444 - RNA, 2043 nt, synthetic construct
  misc_feature 1..2043: note = derived and/or modified CDS sequence (opt1) from DENV-1 CYD23__SSopt-prME(F108S)
  source 1..2043: mol_type = other RNA
atgaagcgcaagaagtccgtgaccatgctgctcatgctgatgcccaccgccctggccttccacctcacgacccggggcggggagccccacatgatcgtctccaagcaggagcgcggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccgccgggacaagcgctccgtggccctcgcgccccacgtgggcctggggctggagacgcggaccgagacctggatgagctccgagggcgcctggaagcagatccagcgcgtcgagacctgggccctccggcacccggggttcacggtgatcgccctgttcctggcgcacgccatcggcaccagcatcacccagaaggggatcatcttcatcctcctgatgctggtgaccccctccatggccatgcgctgcgtcggcatcggcagccgggacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcgcaagctctgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgtccggcaaggggagcctcatcacgtgcgccaagttcaagtgcgtgaccaagctggagggcaagatcgtccagtacgagaacctgaagtactccgtgatcgtgaccgtccacaccggcgaccagcaccaggtggggaacgagagcacggagcacggcaccaccgcgaccatcacgccccaggcccccaccaccgagatccagctcaccgactacggggccctgaccctggactgcagcccccggacgggcctcgacttcaacgagatggtcctgctgaccatgaaggagaagtcctggctcgtgcacaagcagtggttcctggacctgccgctcccctggaccagcggggccagcaccagccaggagacgtggaaccgccaggacctgctggtgaccttcaagaccgcccacgcgaagaagcaggaggtcgtggtgctcggctcccaggagggcgccatgcacaccgccctgacgggggccaccgagatccagaccagcggcaccacgaccatcttcgccgggcacctgaagtgccggctcaagatggacaagctgaccctgaagggcatgtcctacgtcatgtgcaccgggagcttcaagctcgagaaggaggtggcggagacgcagcacggcaccgtgctggtccagatcaagtacgagggcaccgacgccccctgcaagatccccttctccacccaggacgagaagggggtgacgcagaacggccgcctgatcaccgccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacacggcctgggacttcgggagcatcggcggcgtgttcacctccgtcgggaagctggtgcaccagatcttcggcaccgcctacggggtcctcttcagcggcgtgtcctggaccatgaagatcgggatcggcgtgctgctgacgtggctcggcctgaacagccggtccaccagcctgtccatgacctgcatcgccgtggggctcgtcaccctgtacctgggcgtgatggtgcaggcctga

SEQ ID NO: 1445 - RNA, 2043 nt, synthetic construct
  misc_feature 1..2043: note = derived and/or modified CDS sequence (opt1) from DENV-1 CYD23__SSopt-prME(F96H)
  source 1..2043: mol_type = other RNA
atgaagcgcaagaagtccgtgaccatgctgctcatgctgatgcccaccgccctggccttccacctcacgacccggggcggggagccccacatgatcgtcagcaagcaggagcgcggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccgccgggacaagcgctccgtggccctcgcgccccacgtgggcctggggctggagacgcggaccgagacctggatgagctccgagggcgcctggaagcagatccagcgcgtcgagacctgggccctccggcacccggggttcacggtgatcgccctgttcctggcgcacgccatcggcaccagcatcacccagaaggggatcatcttcatcctcctgatgctggtgaccccctccatggccatgcgctgcgtcggcatcggcagccgggacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcgcaagctctgcatcgaggccaagatctccaacaccaccacggacagccggtgcccgacccagggcgaggccaccctggtggaggagcaggacgccaacttcgtctgccgccggacccacgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccaccaccgagatccagctcaccgactacggggccctgaccctggactgcagcccccggacgggcctcgacttcaacgagatggtcctgctgaccatgaaggagaagtcctggctcgtgcacaagcagtggttcctggacctgccgctcccctggaccagcggggccagcacctcccaggagacgtggaaccgccaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccggctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccgcctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtcctcttctccggcgtgagctggaccatgaagatcgggatcggcgtgctgctgacgtggctcggcctgaactcccggagcacctccctgagcatgacctgcatcgccgtggggctcgtcaccctgtacctgggcgtgatggtgcaggcctga

SEQ ID NO: 1446 - RNA, 2043 nt, synthetic construct
  misc_feature 1..2043: note = derived and/or modified CDS sequence (opt1) from DENV-1 CYD23__SSopt-prME(S186F)
  source 1..2043: mol_type = other RNA
atgaagcgcaagaagtccgtgaccatgctgctcatgctgatgcccaccgccctggccttccacctcacgacccggggcggggagccccacatgatcgtcagcaagcaggagcgcggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccgccgggacaagcgctccgtggccctcgcgccccacgtgggcctggggctggagacgcggaccgagacctggatgagctccgagggcgcctggaagcagatccagcgcgtcgagacctgggccctccggcacccggggttcacggtgatcgccctgttcctggcgcacgccatcggcaccagcatcacccagaaggggatcatcttcatcctcctgatgctggtgaccccctccatggccatgcgctgcgtcggcatcggcagccgggacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcgcaagctctgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccaccaccgagatccagctcaccgactacggggccctgaccctggactgcttcccccggacgggcctcgacttcaacgagatggtcctgctgaccatgaaggagaagtcctggctcgtgcacaagcagtggttcctggacctgccgctcccctggaccagcggggccagcaccagccaggagacgtggaaccgccaggacctgctggtgaccttcaagaccgcccacgcgaagaagcaggaggtcgtggtgctcggctcccaggagggcgccatgcacaccgccctgacgggggccaccgagatccagaccagcggcaccacgaccatcttcgccgggcacctgaagtgccggctcaagatggacaagctgaccctgaagggcatgtcctacgtcatgtgcaccgggagcttcaagctcgagaaggaggtggcggagacgcagcacggcaccgtgctggtccagatcaagtacgagggcaccgacgccccctgcaagatccccttctccacccaggacgagaagggggtgacgcagaacggccgcctgatcaccgccaacccgatcgtgaccgacaaggagaagcccgtcaacatcgaggccgagccgcccttcggggagagctacatcgtgatcggcgcgggcgagaaggccctgaagctctcctggttcaagaaggggagctccatcggcaagatgttcgaggccaccgcccgcggggcccggcgcatggcgatcctgggcgacacggcctgggacttcgggagcatcggcggcgtgttcacctccgtcgggaagctggtgcaccagatcttcggcaccgcctacggggtcctcttcagcggcgtgtcctggaccatgaagatcgggatcggcgtgctgctgacgtggctcggcctgaacagccggtccaccagcctgtccatgacctgcatcgccgtggggctcgtcaccctgtacctgggcgtgatggtgcaggcctga

SEQ ID NO: 1447 - RNA, 2043 nt, synthetic construct
  misc_feature 1..2043: note = derived and/or modified CDS sequence (opt1) from DENV-1 CYD23__SSopt-prME(R188L)
  source 1..2043: mol_type = other RNA
atgaagcgcaagaagtccgtgaccatgctgctcatgctgatgcccaccgccctggccttccacctcacgacccggggcggggagccccacatgatcgtcagcaagcaggagcgcggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccgccgggacaagcgctccgtggccctcgcgccccacgtgggcctggggctggagacgcggaccgagacctggatgagctccgagggcgcctggaagcagatccagcgcgtcgagacctgggccctccggcacccggggttcacggtgatcgccctgttcctggcgcacgccatcggcaccagcatcacccagaaggggatcatcttcatcctcctgatgctggtgaccccctccatggccatgcgctgcgtcggcatcggcagccgggacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcgcaagctctgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccaccaccgagatccagctcaccgactacggggccctgaccctggactgcagccccctcacgggcctggacttcaacgagatggtcctgctcaccatgaaggagaagtcctggctggtgcacaagcagtggttcctggacctcccgctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacgggggccaccgagatccagacctccggcaccacgaccatcttcgccgggcacctcaagtgccgcctgaagatggacaagctgaccctcaagggcatgagctacgtcatgtgcaccgggtccttcaagctggagaaggaggtggcggagacgcagcacggcaccgtgctggtccagatcaagtacgagggcaccgacgccccctgcaagatccccttcagcacccaggacgagaagggggtgacgcagaacggccggctgatcaccgccaacccgatcgtgaccgacaaggagaagcccgtcaacatcgaggccgagccgcccttcggggagtcctacatcgtgatcggcgcgggcgagaaggccctcaagctgagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctcgtgcaccagatcttcggcaccgcctacggggtgctgttctccggcgtcagctggaccatgaagatcgggatcggcgtgctgctcacgtggctgggcctgaactcccgcagcacctccctcagcatgacctgcatcgccgtggggctggtcaccctgtacctcggcgtgatggtgcaggcctga

SEQ ID NO: 1448 - RNA, 2043 nt, synthetic construct
  misc_feature 1..2043: note = derived and/or modified CDS sequence (opt1) from DENV-1 CYD23__SSopt-pr(D104A)MEdelstem_TM,(F108S)-JEV
  source 1..2043: mol_type = other RNA
atgaagcgcaagaagtccgtgaccatgctgctcatgctgatgcccaccgccctggccttccacctcacgacccggggcggggagccccacatgatcgtctccaagcaggagcgcggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccgccgggccaagcgctccgtggcgctcgcgccccacgtgggcctggggctggagacgcggaccgagacctggatgagctccgagggcgcctggaagcagatccagcgcgtcgagacctgggccctccggcacccggggttcacggtgatcgccctgttcctggcccacgccatcggcaccagcatcacccagaaggggatcatcttcatcctcctgatgctggtgaccccctccatggccatgcgctgcgtcggcatcggcagccgggacttcgtggaggggctctccggcgccacgtgggtggacgtcgtgctggagcacgggagctgcgtgaccaccatggcgaaggacaagcccaccctggacatcgagctcctgaagacggaggtcaccaaccccgccgtgctgcgcaagctctgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgtccggcaaggggagcctcatcacgtgcgcgaagttcaagtgcgtgaccaagctggagggcaagatcgtccagtacgagaacctgaagtactccgtgatcgtgaccgtccacaccggcgaccagcaccaggtggggaacgagagcacggagcacggcaccaccgccaccatcacgccccaggcccccaccaccgagatccagctcaccgactacggggccctgaccctggactgcagcccccggacgggcctcgacttcaacgagatggtcctgctgaccatgaaggagaagtcctggctcgtgcacaagcagtggttcctggacctgccgctcccctggaccagcggggccagcaccagccaggagacgtggaaccgccaggacctgctggtgaccttcaagaccgcgcacgccaagaagcaggaggtcgtggtgctcggctcccaggagggcgccatgcacaccgccctgacgggggccaccgagatccagaccagcggcaccacgaccatcttcgcggggcacctgaagtgccggctcaagatggacaagctgaccctgaagggcatgtcctacgtcatgtgcaccgggagcttcaagctcgagaaggaggtggccgagacgcagcacggcaccgtgctggtccagatcaagtacgagggcaccgacgccccctgcaagatccccttctccacccaggacgagaagggggtgacgcagaacggccgcctgatcaccgccaacccgatcgtgaccgacaaggagaagcccgtcaacatcgaggcggagccgcccttcggggagagctacatcgtgatcggcgccggcgagaaggccctgaagctctcctggttcaagaaggggagcaccctgggcaaggccttctccacgaccctgaagggggcccagcggctcgcggccctgggcgacaccgcctgggacttcgggagcatcggcggcgtgttcaactccatcgggcgcgccgtccaccaggtgttcggcggggccttccgcaccctgttcggcgggatgagctggatcacgcagggcctcatgggcgcgctgctgctctggatgggggtgaacgcccgggaccgctccatcgccctggccttcctggccaccggcggggtcctcgtgttcctggcgaccaacgtgcacgcctga

SEQ ID NO: 1449 - RNA, 2043 nt, synthetic construct
  misc_feature 1..2043: note = derived and/or modified CDS sequence (opt1) from DENV-1 CYD23__SSopt-prMEdelstem_TM,(H261N)-JEV
  source 1..2043: mol_type = other RNA
atgaagcgcaagaagtccgtgaccatgctgctcatgctgatgcccaccgccctggccttccacctcacgacccggggcggggagccccacatgatcgtcagcaagcaggagcgcggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccgccgggacaagcgctccgtggccctcgcgccccacgtgggcctggggctggagacgcggaccgagacctggatgagctccgagggcgcctggaagcagatccagcgcgtcgagacctgggccctccggcacccggggttcacggtgatcgccctgttcctggcgcacgccatcggcaccagcatcacccagaaggggatcatcttcatcctcctgatgctggtgaccccctccatggccatgcgctgcgtcggcatcggcagccgggacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcgcaagctctgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccaccaccgagatccagctcaccgactacggggccctgaccctggactgcagcccccggacgggcctcgacttcaacgagatggtcctgctgaccatgaaggagaagtcctggctcgtgcacaagcagtggttcctggacctgccgctcccctggaccagcggggccagcacctcccaggagacgtggaaccgccaggacctgctggtgaccttcaagaccgcccacgcgaagaagcaggaggtcgtggtgctcggcagccaggagggcgccatgaacaccgccctgacgggggccaccgagatccagacctccggcaccacgaccatcttcgccgggcacctgaagtgccggctcaagatggacaagctgaccctgaagggcatgagctacgtcatgtgcaccgggtccttcaagctcgagaaggaggtggcggagacgcagcacggcaccgtgctggtccagatcaagtacgagggcaccgacgccccctgcaagatccccttcagcacccaggacgagaagggggtgacgcagaacggccgcctgatcaccgccaacccgatcgtgaccgacaaggagaagcccgtcaacatcgaggccgagccgcccttcggggagtcctacatcgtgatcggcgcgggcgagaaggccctgaagctcagctggttcaagaaggggtccaccctgggcaaggccttcagcacgaccctgaagggggcccagcggctcgccgcgctgggcgacaccgcctgggacttcgggtccatcggcggcgtgttcaacagcatcgggcgcgccgtccaccaggtgttcggcggggccttccgcaccctgttcggcgggatgtcctggatcacgcagggcctcatgggcgccctgctgctctggatgggggtgaacgcgcgggaccgcagcatcgccctggccttcctggccaccggcggggtcctcgtgttcctggccaccaacgtgcacgcgtga

SEQ ID NO: 1450 - RNA, 2043 nt, synthetic construct
  misc_feature 1..2043: note = derived and/or modified CDS sequence (opt1) from DENV-1 CYD23__SSopt-prMEdelstem_TM,(R188L,A267T)-JEV
  source 1..2043: mol_type = other RNA
atgaagcgcaagaagtccgtgaccatgctgctcatgctgatgcccaccgccctggccttccacctcacgacccggggcggggagccccacatgatcgtcagcaagcaggagcgcggcaagagcctgctgttcaagacctccgcgggggtgaacatgtgcaccctcatcgccatggacctgggcgagctgtgcgaggacacgatgacctacaagtgcccccggatcaccgaggccgagcccgacgacgtggactgctggtgcaacgccaccgacacgtgggtcacctacgggacctgcagccagaccggcgagcaccgccgggacaagcgctccgtggccctcgcgccccacgtgggcctggggctggagacgcggaccgagacctggatgagctccgagggcgcctggaagcagatccagcgcgtcgagacctgggccctccggcacccggggttcacggtgatcgccctgttcctggcgcacgccatcggcaccagcatcacccagaaggggatcatcttcatcctcctgatgctggtgaccccctccatggccatgcgctgcgtcggcatcggcagccgggacttcgtggaggggctctccggcgccacgtgggtggacgtcgtgctggagcacgggagctgcgtgaccaccatggccaaggacaagcccaccctggacatcgagctcctgaagacggaggtcaccaaccccgcggtgctgcgcaagctctgcatcgaggccaagatctccaacaccaccacggacagccggtgcccgacccagggcgaggccaccctggtggaggagcaggacgccaacttcgtctgccgccggaccttcgtggaccgcggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcacgccccaggcccccacgaccgagatccagctcaccgactacggggccctgaccctggactgcagccccctcacgggcctggacttcaacgagatggtcctgctcaccatgaaggagaagtcctggctggtgcacaagcagtggttcctggacctcccgctgccctggaccagcggggccagcacctcccaggagacgtggaaccggcaggacctgctcgtgaccttcaagaccgcccacgcgaagaagcaggaggtcgtggtgctgggcagccaggagggcgccatgcacaccgccctgacggggaccaccgagatccagacctccggcacgaccaccatcttcgccgggcacctcaagtgccgcctgaagatggacaagctgaccctcaagggcatgagctacgtcatgtgcacggggtccttcaagctggagaaggaggtggccgagacccagcacggcaccgtgctggtccagatcaagtacgagggcaccgacgcgccctgcaagatccccttcagcacgcaggacgagaagggggtgacccagaacggccggctgatcaccgccaacccgatcgtgaccgacaaggagaagcccgtcaacatcgaggccgagccgcccttcggggagtcctacatcgtgatcggcgccggcgagaaggcgctcaagctgagctggttcaagaaggggtccacgctgggcaaggccttcagcaccaccctcaagggggcccagcgcctggccgccctgggcgacaccgcgtgggacttcgggtccatcggcggcgtgttcaacagcatcgggcgggccgtccaccaggtgttcggcggggccttccgcaccctcttcggcgggatgtcctggatcacccagggcctgatgggcgccctgctcctgtggatgggggtgaacgcccgcgaccggagcatcgcgctggccttcctcgccaccggcggggtcctggtgttcctggccaccaacgtgcacgcctga

SEQ ID NO: 1451 - RNA, 300 nt, synthetic construct
  misc_feature 1..300: note = derived and/or modified CDS sequence (opt1) from DENV-2 CYD2-T__C
  source 1..300: mol_type = other RNA
atgaacaaccagcgcaagaaggccaagaacacccccttcaacatgctgaagcgggagcgcaaccgggtgagcaccgtccagcagctcacgaagcgcttcagcctgggcatgctgcaggggcggggccccctcaagctgttcatggccctggtggcgttcctccgcttcctgaccatcccgcccaccgccgggatcctgaagcggtggggcaccatcaagaagtccaaggccatcaacgtgctccgcgggttccggaaggagatcggccgcatgctgaacatcctgaaccggcgccggcgc

SEQ ID NO: 1452 - RNA, 342 nt, synthetic construct
  misc_feature 1..342: note = derived and/or modified CDS sequence (opt1) from DENV-2 CYD2-T__C-SSc
  source 1..342: mol_type = other RNA
atgaacaaccagcgcaagaaggccaagaacacccccttcaacatgctgaagcgggagcgcaaccgggtgagcaccgtccagcagctcacgaagcgcttctccctgggcatgctgcaggggcggggccccctcaagctgttcatggccctggtggcgttcctccgcttcctgaccatcccgcccaccgccgggatcctgaagcggtggggcaccatcaagaagtccaaggccatcaacgtgctccgcgggttccggaaggagatcggccgcatgctgaacatcctgaaccggcgccggcgcagcgccggcatgatcatcatgctcatccccacggtcatggcc

SEQ ID NO: 1453 - RNA, 273 nt, synthetic construct
  misc_feature 1..273: note = derived and/or modified CDS sequence (opt1) from DENV-2 CYD2-T__pr
  source 1..273: mol_type = other RNA
ttccacctgaccacccgcaacggcgagccccacatgatcgtgagccggcaggagaaggggaagtccctcctgttcaagacggaggacggcgtcaacatgtgcaccctgatggccatggacctcggggagctgtgcgaggacaccatcacctacaagtgcccgctgctccgccagaacgagcccgaggacatcgactgctggtgcaacagcacgtccacctgggtgacctacgggacctgcacgaccatgggcgagcaccggcgcgagaagcgg

SEQ ID NO: 1454 - RNA, 225 nt, synthetic construct
  misc_feature 1..225: note = derived and/or modified CDS sequence (opt1) from DENV-2 CYD2-T__M
  source 1..225: mol_type = other RNA
agcgtggccctggtcccccacgtgggcatggggctcgagacccgcaccgagacgtggatgtccagcgagggcgcctggaagcacgtgcagcggatcgagacctggatcctgcgccacccggggttcaccatgatggcggccatcctggcctacaccatcggcacgacccacttccagcgggccctcatcttcatcctgctgaccgccgtcaccccctccatgacg

SEQ ID NO: 1455 - RNA, 498 nt, synthetic construct
  misc_feature 1..498: note = derived and/or modified CDS sequence (opt1) from DENV-2 CYD2-T__prM
  source 1..498: mol_type = other RNA
ttccacctgaccacccgcaacggcgagccccacatgatcgtgagccggcaggagaaggggaagtccctcctgttcaagacggaggacggcgtcaacatgtgcaccctgatggccatggacctcggggagctgtgcgaggacaccatcacctacaagtgcccgctgctccgccagaacgagcccgaggacatcgactgctggtgcaacagcacgtccacctgggtgacctacgggacctgcacgaccatgggcgagcaccggcgcgagaagcggagcgtggccctggtcccccacgtgggcatgggcctggagacccgcaccgagacgtggatgtccagcgagggggcgtggaagcacgtgcagcggatcgagacctggatcctccgccaccccggcttcaccatgatggccgccatcctggcctacaccatcgggacgacccacttccagcgggccctgatcttcatcctcctgaccgcggtcaccccgtccatgacg

SEQ ID NO: 1456 - RNA, 1485 nt, synthetic construct
  misc_feature 1..1485: note = derived and/or modified CDS sequence (opt1) from DENV-2 CYD2-T__E
  source 1..1485: mol_type = other RNA
atgcgctgcatcggcatgagcaaccgggacttcgtggagggggtctccggcgggagctgggtggacatcgtgctggagcacggctcctgcgtcaccaccatggccaagaacaagcccacgctcgacttcgagctgatcaagaccgaggccaagcagccggcgaccctgcgcaagtactgcatcgaggccaagctcaccaacacgaccaccgagagccggtgccccacccagggggagccctccctgaacgaggagcaggacaagcgcttcgtgtgcaagcacagcatggtggaccggggctggggcaacgggtgcggcctgttcgggaagggcgggatcgtcacgtgcgccatgttccgctgcaagaagaacatggagggcaaggtggtgcagcccgagaacctcgagtacaccatcgtcatcaccccgcactccggcgaggagcacgccgtggggaacgacaccggcaagcacgggaaggagatcaagatcacgccccagagctccatcaccgaggccgagctgaccggctacggcaccgtgacgatggagtgcagcccccggaccgggctggacttcaacgagatggtcctcctgcagatggagaacaaggcgtggctggtgcaccgccagtggttcctcgacctgcccctgccgtggctccccggcgccgacacccaggggtccaactggatccagaaggagaccctggtgacgttcaagaacccccacgccaagaagcaggacgtcgtggtgctgggcagccaggagggggccatgcacaccgcgctcaccggcgccaccgagatccagatgtccagcggcaacctgctgttcacggggcacctcaagtgccggctgcgcatggacaagctgcagctcaagggcatgtcctacagcatgtgcaccgggaagttcaaggtcgtgaaggagatcgccgagacccagcacggcaccatcgtgatccgggtccagtacgagggggacggctccccctgcaagatcccgttcgagatcatggacctggagaagcgccacgtgctgggccggctcatcacggtgaaccccatcgtcaccgagaaggacagccccgtgaacatcgaggccgagcccccgttcggggactcctacatcatcatcggcgtcgagcccgggcagctgaagctgaactggttcaagaagggcagcagcatcgggcagatgttcgagaccaccatgcgcggcgccaagcggatggcgatcctcggcgacacggcctgggacttcgggtccctgggcggggtgttcaccagcatcggcaaggccctgcaccaggtgttcggcgccatctacggggccgcgttctccggcgtcagctggaccatgaagatcctcatcggggtgatcatcacctggatcggcatgaactcccgcagcacgtccctgagcgtgaccctggtcctcgtggggatcgtgaccctgtacctgggcgtcatggtgcaggcc

SEQ ID NO: 1457 - RNA, 1983 nt, synthetic construct
  misc_feature 1..1983: note = derived and/or modified CDS sequence (opt1) from DENV-2 CYD2-T__prME
  source 1..1983: mol_type = other RNA
ttccacctgaccacccgcaacggcgagccccacatgatcgtgagccggcaggagaaggggaagtccctcctgttcaagacggaggacggcgtcaacatgtgcaccctgatggccatggacctcggggagctgtgcgaggacaccatcacctacaagtgccccctgctccgccagaacgagcccgaggacatcgactgctggtgcaacagcacgtccacctgggtgacctacgggacctgcacgaccatgggggagcaccggcgcgagaagcggagcgtggccctggtcccccacgtgggcatgggcctggagacccgcaccgagacgtggatgtccagcgagggggcgtggaagcacgtgcagcggatcgagacctggatcctccgccaccccggcttcaccatgatggccgccatcctggcctacaccatcgggacgacccacttccagcgggccctgatcttcatcctcctgaccgcggtcaccccgtccatgacgatgcgctgcatcggcatgagcaaccgggacttcgtggagggggtgtccggcggcagctgggtcgacatcgtgctggagcacgggtcctgcgtgaccaccatggccaagaacaagcccaccctcgacttcgagctgatcaagacggaggccaagcagcccgccaccctgcgcaagtactgcatcgaggcgaagctcaccaacaccacgaccgagagccggtgccccacccagggcgagccgtccctgaacgaggagcaggacaagcgcttcgtctgcaagcacagcatggtggaccgggggtggggcaacggctgcgggctgttcggcaagggcggcatcgtgacctgcgccatgttccgctgcaagaagaacatggaggggaaggtcgtgcagcccgagaacctcgagtacacgatcgtgatcacgccccactccggcgaggagcacgccgtcggcaacgacaccgggaagcacggcaaggagatcaagatcacgccccagagctccatcaccgaggccgagctgaccgggtacggcaccgtgaccatggagtgcagcccgcggaccgggctggacttcaacgagatggtgctcctgcagatggagaacaaggcctggctggtccaccgccagtggttcctcgacctgcccctgccctggctccccggcgcggacacccagggctccaactggatccagaaggagaccctggtgaccttcaagaacccgcacgccaagaagcaggacgtggtcgtgctggggagccaggagggcgccatgcacaccgccctcacgggggccaccgagatccagatgagctccggcaacctgctgttcaccgggcacctcaagtgccggctgcgcatggacaagctgcagctcaagggcatgagctactccatgtgcaccggcaagttcaaggtcgtgaaggagatcgcggagacgcagcacgggaccatcgtgatccgggtccagtacgagggcgacgggagcccctgcaagatccccttcgagatcatggacctggagaagcgccacgtgctgggccgcctcatcaccgtgaaccccatcgtcaccgagaaggactccccggtgaacatcgaggccgagccgcccttcggcgacagctacatcatcatcggggtggagcccggccagctgaagctgaactggttcaagaaggggtccagcatcggccagatgttcgagacgaccatgcgcggggccaagcggatggccatcctcggcgacaccgcctgggacttcggctccctcgggggcgtcttcaccagcatcgggaaggcgctgcaccaggtgttcggcgccatctacggggccgccttctccggcgtgagctggacgatgaagatcctgatcggcgtcatcatcacctggatcgggatgaactcccggagcacctccctgagcgtgaccctggtgctggtcggcatcgtgacgctctacctgggggtgatggtccaggcc

SEQ ID NO: 1458 - RNA, 2025 nt, synthetic construct
  misc_feature 1..2025: note = derived and/or modified CDS sequence (opt1) from DENV-2 CYD2-T__SSc-prME
  source 1..2025: mol_type = other RNA
agcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcacgccccacagcggcgaggagcacgccgtggggaacgacaccggcaagcacgggaaggagatcaagatcaccccgcagtccagcatcaccgaggcggagctgaccggctacgggaccgtgaccatggagtgcagcccccggacgggcctcgacttcaacgagatggtcctgctgcagatggagaacaaggcctggctcgtgcaccgccagtggttcctggacctgcccctcccctggctgccgggcgccgacacccaggggtccaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctcctgttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaacccgatcgtgacggagaaggacagccccgtgaacatcgaggccgagccgcccttcggggactcctacatcatcatcggcgtcgagcccgggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctccaccaggtgttcggggccatctacggcgccgcgttcagcggcgtctcctggaccatgaagatcctgatcggggtgatcatcacctggatcggcatgaacagccggtccaccagcctgtccgtgacgctggtcctcgtggggatcgtgaccctgtacctgggcgtcatggtgcaggcc

SEQ ID NO: 1459 - RNA, 2325 nt, synthetic construct
  misc_feature 1..2325: note = derived and/or modified CDS sequence (opt1) from DENV-2 CYD2-T__C-prME
  source 1..2325: mol_type = other RNA
atgaacaaccagcgcaagaaggccaagaacacccccttcaacatgctgaagcgggagcgcaaccgggtgagcaccgtccagcagctcacgaagcgcttctccctgggcatgctgcaggggcggggcccgctcaagctgttcatggccctggtggcgttcctccgcttcctgaccatcccgcccaccgccgggatcctgaagcggtggggcaccatcaagaagtccaaggccatcaacgtgctccgcgggttccggaaggagatcggccgcatgctgaacatcctgaaccggcgccggcgctccgccggcatgatcatcatgctcatccccacggtcatggccttccacctgaccacccggaacggggagccccacatgatcgtgagccgccaggagaagggcaagtccctcctgttcaagaccgaggacggggtgaacatgtgcacgctgatggcgatggacctgggcgagctctgcgaggacaccatcacctacaagtgccccctgctgcggcagaacgagcccgaggacatcgactgctggtgcaacagcacctccacgtgggtcacctacgggacctgcaccacgatgggcgagcaccgccgggagaagcgcagcgtggccctcgtgccccacgtcggcatggggctggagacccggaccgagacctggatgtccagcgagggcgcctggaagcacgtgcagcgcatcgagacgtggatcctgcgccacccggggttcaccatgatggccgcgatcctcgcctacaccatcggcaccacgcacttccagcgggccctgatcttcatcctgctcaccgccgtgaccccctccatgaccatgcgctgcatcggcatgagcaaccgggacttcgtcgagggggtgtccggcgggagctgggtggacatcgtcctggagcacggctcctgcgtgacgaccatggccaagaacaagcccaccctggacttcgagctcatcaagaccgaggcgaagcagcccgccacgctgcgcaagtactgcatcgaggccaagctgaccaacaccaccacggagagccggtgcccgacccagggggagccctccctcaacgaggagcaggacaagcgcttcgtgtgcaagcacagcatggtcgaccggggctggggcaacgggtgcggcctgttcgggaagggcgggatcgtgacctgcgccatgttccgctgcaagaagaacatggagggcaaggtggtccagcccgagaacctggagtacaccatcgtgatcacgccccactccggcgaggagcacgccgtggggaacgacaccggcaagcacgggaaggagatcaagatcaccccgcagagcagcatcaccgaggcggagctcaccggctacgggacggtcaccatggagtgcagcccccggaccggcctggacttcaacgagatggtgctgctccagatggagaacaaggcctggctggtccaccgccagtggttcctggacctccccctgccctggctgccgggcgccgacacccaggggagcaactggatccagaaggagacgctcgtgaccttcaagaacccccacgccaagaagcaggacgtggtcgtgctgggctcccaggagggggccatgcacaccgcgctgaccggcgccacggagatccagatgagctccggcaacctcctgttcaccgggcacctgaagtgccggctgcgcatggacaagctccagctgaagggcatgagctactccatgtgcaccgggaagttcaaggtggtcaaggagatcgccgagacccagcacggcacgatcgtgatccgggtgcagtacgagggggacggcagcccctgcaagatccccttcgagatcatggacctggagaagcgccacgtcctcggccggctgatcaccgtgaacccgatcgtgaccgagaaggactcccccgtcaacatcgaggccgagccgcccttcggggacagctacatcatcatcggcgtggagcccgggcagctgaagctcaactggttcaagaagggctccagcatcgggcagatgttcgagaccacgatgcgcggcgccaagcggatggcgatcctgggcgacaccgcctgggacttcgggtccctgggcggggtgttcaccagcatcggcaaggccctccaccaggtcttcggggccatctacggcgcggccttctccggcgtgagctggaccatgaagatcctgatcggggtgatcatcacgtggatcggcatgaactcccgcagcacctccctgagcgtcaccctcgtgctggtggggatcgtcaccctgtacctcggcgtgatggtgcaggcc

SEQ ID NO: 1460 - RNA, 45 nt, synthetic construct; identical to SEQ ID NO: 1304
  misc_feature 1..45: note = derived and/or modified CDS sequence (opt1) from DENV-2 CYD2-T__SSc
  source 1..45: mol_type = other RNA

SEQ ID NO: 1461 - RNA, 57 nt, synthetic construct
  misc_feature 1..57: note = derived and/or modified CDS sequence (opt1) from DENV-2 CYD2-T__SSopt
  source 1..57: mol_type = other RNA
atgaagcgcaagaagagcgccggcatgatcatcatgctgatccccaccgtgatggcc

SEQ ID NO: 1462 - RNA, 57 nt, synthetic construct
  misc_feature 1..57: note = derived and/or modified CDS sequence (opt1) from DENV-2 CYD2-T__SSm
  source 1..57: mol_type = other RNA
atgttccagcgcgccctgatcttcatcctcctgaccgccgtgacccccagcatgacg

SEQ ID NO: 1463 - RNA, 1488 nt, synthetic construct
  misc_feature 1..1488: note = derived and/or modified CDS sequence (opt1) from DENV-2 CYD2-T__E
  source 1..1488: mol_type = other RNA
atgcgctgcatcggcatgagcaaccgggacttcgtggagggggtctccggcgggagctgggtggacatcgtgctggagcacggctcctgcgtcaccaccatggccaagaacaagcccacgctcgacttcgagctgatcaagaccgaggccaagcagccggcgaccctgcgcaagtactgcatcgaggccaagctcaccaacacgaccaccgagagccggtgccccacccagggggagccctccctgaacgaggagcaggacaagcgcttcgtgtgcaagcacagcatggtggaccggggctggggcaacgggtgcggcctgttcgggaagggcgggatcgtcacgtgcgccatgttccgctgcaagaagaacatggagggcaaggtggtgcagcccgagaacctcgagtacaccatcgtcatcaccccgcactccggcgaggagcacgccgtggggaacgacaccggcaagcacgggaaggagatcaagatcacgccccagagctccatcaccgaggccgagctgaccggctacggcaccgtgacgatggagtgcagcccccggaccgggctggacttcaacgagatggtcctcctgcagatggagaacaaggcgtggctggtgcaccgccagtggttcctcgacctgcccctgccgtggctccccggcgccgacacccaggggtccaactggatccagaaggagaccctggtgacgttcaagaacccccacgccaagaagcaggacgtcgtggtgctgggcagccaggagggggccatgcacaccgcgctcaccggcgccaccgagatccagatgtccagcggcaacctgctgttcacggggcacctcaagtgccggctgcgcatggacaagctgcagctcaagggcatgtcctacagcatgtgcaccgggaagttcaaggtcgtgaaggagatcgccgagacccagcacggcaccatcgtgatccgggtccagtacgagggggacggctccccctgcaagatcccgttcgagatcatggacctggagaagcgccacgtgctgggccggctcatcacggtgaaccccatcgtcaccgagaaggacagccccgtgaacatcgaggccgagcccccgttcggggactcctacatcatcatcggcgtcgagcccgggcagctgaagctgaactggttcaagaagggcagcagcatcgggcagatgttcgagaccaccatgcgcggcgccaagcggatggcgatcctcggcgacacggcctgggacttcgggtccctgggcggggtgttcaccagcatcggcaaggccctgcaccaggtgttcggcgccatctacggggccgcgttctccggcgtcagctggaccatgaagatcctcatcggggtgatcatcacctggatcggcatgaactcccgcagcacgtccctgagcgtgaccctggtcctcgtggggatcgtgaccctgtacctgggcgtcatggtgcaggcctga

SEQ ID NO: 1464 - RNA, 1182 nt, synthetic construct
  misc_feature 1..1182: note = derived and/or modified CDS sequence (opt1) from DENV-2 CYD2-T__EdelTM-variant (aa1-394)
  source 1..1182: mol_type = other RNA
atgcgctgcatcggcatgagcaaccgggacttcgtggagggggtctccggcgggagctgggtggacatcgtgctggagcacggctcctgcgtcaccaccatggccaagaacaagcccacgctcgacttcgagctgatcaagaccgaggccaagcagccggcgaccctgcgcaagtactgcatcgaggccaagctcaccaacacgaccaccgagagccggtgccccacccagggggagccctccctgaacgaggagcaggacaagcgcttcgtgtgcaagcacagcatggtggaccggggctggggcaacgggtgcggcctgttcgggaagggcgggatcgtcacgtgcgccatgttccgctgcaagaagaacatggagggcaaggtggtgcagcccgagaacctcgagtacaccatcgtcatcaccccgcactccggcgaggagcacgccgtggggaacgacaccggcaagcacgggaaggagatcaagatcacgccccagagctccatcaccgaggccgagctgaccggctacggcaccgtgacgatggagtgcagcccccggaccgggctggacttcaacgagatggtcctcctgcagatggagaacaaggcgtggctggtgcaccgccagtggttcctcgacctgcccctgccgtggctccccggcgccgacacccaggggtccaactggatccagaaggagaccctggtgacgttcaagaacccccacgccaagaagcaggacgtcgtggtgctgggcagccaggagggggccatgcacaccgcgctcaccggcgccaccgagatccagatgtccagcggcaacctgctgttcacggggcacctcaagtgccggctgcgcatggacaagctgcagctcaagggcatgtcctacagcatgtgcaccgggaagttcaaggtcgtgaaggagatcgccgagacccagcacggcaccatcgtgatccgggtccagtacgagggggacggctccccctgcaagatcccgttcgagatcatggacctggagaagcgccacgtgctgggccggctcatcacggtgaaccccatcgtcaccgagaaggacagccccgtgaacatcgaggccgagcccccgttcggggactcctacatcatcatcggcgtcgagcccgggcagctgaagctgaactggttcaagaag

SEQ ID NO: 1465 - RNA, 1272 nt, synthetic construct
  misc_feature 1..1272: note = derived and/or modified CDS sequence (opt1) from DENV-2 CYD2-T__EdelTM-variant (aa1-424)
  source 1..1272: mol_type = other RNA
atgcgctgcatcggcatgagcaaccgggacttcgtggagggggtctccggcgggagctgggtggacatcgtgctggagcacggctcctgcgtcaccaccatggccaagaacaagcccacgctcgacttcgagctgatcaagaccgaggccaagcagccggcgaccctgcgcaagtactgcatcgaggccaagctcaccaacacgaccaccgagagccggtgccccacccagggggagccctccctgaacgaggagcaggacaagcgcttcgtgtgcaagcacagcatggtggaccggggctggggcaacgggtgcggcctgttcgggaagggcgggatcgtcacgtgcgccatgttccgctgcaagaagaacatggagggcaaggtggtgcagcccgagaacctcgagtacaccatcgtcatcaccccgcactccggcgaggagcacgccgtggggaacgacaccggcaagcacgggaaggagatcaagatcacgccccagagctccatcaccgaggccgagctgaccggctacggcaccgtgacgatggagtgcagcccccggaccgggctggacttcaacgagatggtcctcctgcagatggagaacaaggcgtggctggtgcaccgccagtggttcctcgacctgcccctgccgtggctccccggcgccgacacccaggggtccaactggatccagaaggagaccctggtgacgttcaagaacccccacgccaagaagcaggacgtcgtggtgctgggcagccaggagggggccatgcacaccgcgctcaccggcgccaccgagatccagatgtccagcggcaacctgctgttcacggggcacctcaagtgccggctgcgcatggacaagctgcagctcaagggcatgtcctacagcatgtgcaccgggaagttcaaggtcgtgaaggagatcgccgagacccagcacggcaccatcgtgatccgggtccagtacgagggggacggctccccctgcaagatcccgttcgagatcatggacctggagaagcgccacgtgctgggccggctcatcacggtgaaccccatcgtcaccgagaaggacagccccgtgaacatcgaggccgagcccccgttcggggactcctacatcatcatcggcgtcgagcccgggcagctgaagctgaactggttcaagaagggcagcagcatcgggcagatgttcgagaccaccatgcgcggcgccaagcggatggcgatcctcggcgacacggcctgggacttcgggtcc

SEQ ID NO: 1466 - RNA, 1263 nt, synthetic construct
  misc_feature 1..1263: note = derived and/or modified CDS sequence (opt1) from DENV-2 CYD2-T__EdelTM-variant (aa1-421)
  source 1..1263: mol_type = other RNA
atgcgctgcatcggcatgagcaaccgggacttcgtggagggggtctccggcgggagctgggtggacatcgtgctggagcacggctcctgcgtcaccaccatggccaagaacaagcccacgctcgacttcgagctgatcaagaccgaggccaagcagccggcgaccctgcgcaagtactgcatcgaggccaagctcaccaacacgaccaccgagagccggtgccccacccagggggagccctccctgaacgaggagcaggacaagcgcttcgtgtgcaagcacagcatggtggaccggggctggggcaacgggtgcggcctgttcgggaagggcgggatcgtcacgtgcgccatgttccgctgcaagaagaacatggagggcaaggtggtgcagcccgagaacctcgagtacaccatcgtcatcaccccgcactccggcgaggagcacgccgtggggaacgacaccggcaagcacgggaaggagatcaagatcacgccccagagctccatcaccgaggccgagctgaccggctacggcaccgtgacgatggagtgcagcccccggaccgggctggacttcaacgagatggtcctcctgcagatggagaacaaggcgtggctggtgcaccgccagtggttcctcgacctgcccctgccgtggctccccggcgccgacacccaggggtccaactggatccagaaggagaccctggtgacgttcaagaacccccacgccaagaagcaggacgtcgtggtgctgggcagccaggagggggccatgcacaccgcgctcaccggcgccaccgagatccagatgtccagcggcaacctgctgttcacggggcacctcaagtgccggctgcgcatggacaagctgcagctcaagggcatgtcctacagcatgtgcaccgggaagttcaaggtcgtgaaggagatcgccgagacccagcacggcaccatcgtgatccgggtccagtacgagggggacggctccccctgcaagatcccgttcgagatcatggacctggagaagcgccacgtgctgggccggctcatcacggtgaaccccatcgtcaccgagaaggacagccccgtgaacatcgaggccgagcccccgttcggggactcctacatcatcatcggcgtcgagcccgggcagctgaagctgaactggttcaagaagggcagcagcatcgggcagatgttcgagaccaccatgcgcggcgccaagcggatggcgatcctcggcgacacggcctgggac

SEQ ID NO: 1467 - RNA, 2031 nt, synthetic construct
  misc_feature 1..2031: note = derived and/or modified CDS sequence (opt1) from DENV-2 CYD2-T__SSc-prME
  source 1..2031: mol_type = other RNA
atgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcacgccccacagcggcgaggagcacgccgtggggaacgacaccggcaagcacgggaaggagatcaagatcaccccgcagtccagcatcaccgaggcggagctgaccggctacgggaccgtgaccatggagtgcagcccccggacgggcctcgacttcaacgagatggtcctgctgcagatggagaacaaggcctggctcgtgcaccgccagtggttcctggacctgcccctcccctggctgccgggcgccgacacccaggggtccaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctcctgttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaacccgatcgtgacggagaaggacagccccgtgaacatcgaggccgagccgcccttcggggactcctacatcatcatcggcgtcgagcccgggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctccaccaggtgttcggggccatctacggcgccgcgttcagcggcgtctcctggaccatgaagatcctgatcggggtgatcatcacctggatcggcatgaacagccggtccaccagcctgtccgtgacgctggtcctcgtggggatcgtgaccctgtacctgggcgtcatggtgcaggcctga

SEQ ID NO: 1468 - RNA, 2031 nt, synthetic construct
  misc_feature 1..2031: note = derived and/or modified CDS sequence (opt1) from DENV-2 CYD2-T__SSc-prME(F108S)
  source 1..2031: mol_type = other RNA
atgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcagcgggaagggcgggatcgtcacgtgcgccatgttccgctgcaagaagaacatggagggcaaggtggtgcagcccgagaacctggagtacaccatcgtcatcacgccccactccggcgaggagcacgccgtggggaacgacaccggcaagcacgggaaggagatcaagatcaccccgcagagctccatcaccgaggcggagctgaccggctacgggaccgtgaccatggagtgcagcccccggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggctcccaggagggggccatgcacacggcgctgaccggcgccaccgagatccagatgagctccgggaacctcctgttcaccggccacctgaagtgccggctgcgcatggacaagctccagctgaagggcatgagctactccatgtgcacggggaagttcaaggtggtgaaggagatcgccgagacccagcacggcaccatcgtcatccgggtgcagtacgagggggacggcagcccctgcaagatccccttcgagatcatggacctggagaagcgccacgtgctcggccgcctgatcaccgtcaacccgatcgtgacggagaaggactcccccgtgaacatcgaggccgagccgcccttcggggacagctacatcatcatcggcgtcgagcccgggcagctgaagctcaactggttcaagaagggctccagcatcgggcagatgttcgagaccaccatgcggggcgccaagcgcatggcgatcctgggcgacaccgcctgggacttcgggtccctgggcggggtgttcacgagcatcggcaaggccctccaccaggtgttcggggccatctacggcgccgcgttctccggcgtcagctggaccatgaagatcctgatcggggtgatcatcacctggatcggcatgaactcccggagcacctccctgagcgtgacgctggtcctcgtggggatcgtgaccctgtacctgggcgtcatggtgcaggcctga

SEQ ID NO: 1469 - RNA, 2031 nt, synthetic construct
  misc_feature 1..2031: note = derived and/or modified CDS sequence (opt1) from DENV-2 CYD2-T__SSc-prMEdelstem_TM-JEV
  source 1..2031: mol_type = other RNA
atgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcacgccccacagcggcgaggagcacgccgtggggaacgacaccggcaagcacgggaaggagatcaagatcaccccgcagtccagcatcaccgaggcggagctgaccggctacgggaccgtgaccatggagtgcagcccccggacgggcctcgacttcaacgagatggtcctgctgcagatggagaacaaggcctggctcgtgcaccgccagtggttcctggacctgcccctcccctggctgccgggcgccgacacccaggggtccaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctcctgttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaacccgatcgtgacggagaaggacagccccgtgaacatcgaggccgagccgcccttcggggactcctacatcatcatcggcgtcgagcccgggcagctgaagctcaactggttcaagaagggcagcaccctggggaaggccttctccaccaccctgaagggcgcgcagcggctcgccgccctgggcgacacggcctgggacttcgggagcatcggcggggtgttcaactccatcggccgcgccgtgcaccaggtcttcgggggcgcgttccggaccctgttcggcgggatgagctggatcacccagggcctgatgggggccctcctgctgtggatgggcgtgaacgcccgcgaccggtccatcgccctcgcgttcctggccaccgggggcgtgctggtcttcctcgccacgaacgtgcacgcctga

SEQ ID NO: 1470 - RNA, 1332 nt, synthetic construct
  misc_feature 1..1332: note = derived and/or modified CDS sequence (opt1) from DENV-2 CYD2-T__SSm-EdelTM
  source 1..1332: mol_type = other RNA
atgttccagcgcgccctgatcttcatcctcctgaccgccgtgacccccagcatgacgatgcggtgcatcggcatgtccaaccgcgacttcgtcgagggggtgagcggcgggtcctgggtggacatcgtcctggagcacggcagctgcgtgaccaccatggcgaagaacaagccgaccctcgacttcgagctgatcaagacggaggccaagcagcccgccaccctgcggaagtactgcatcgaggccaagctcaccaacaccacgaccgagtcccgctgccccacccagggggagcccagcctgaacgaggagcaggacaagcggttcgtgtgcaagcactccatggtcgaccgcggctggggcaacgggtgcggcctgttcgggaagggcgggatcgtgacctgcgccatgttccggtgcaagaagaacatggagggcaaggtggtccagccggagaacctcgagtacacgatcgtgatcacgccccacagcggcgaggagcacgcggtggggaacgacaccggcaagcacgggaaggagatcaagatcacgccccagtccagcatcaccgaggccgagctgaccggctacggcaccgtcaccatggagtgcagcccccgcaccgggctggacttcaacgagatggtgctcctgcagatggagaacaaggcctggctggtgcaccggcagtggttcctcgacctgccgctgccctggctccccggcgccgacacccaggggtccaactggatccagaaggagaccctggtcaccttcaagaacccccacgcgaagaagcaggacgtggtggtcctgggctcccaggagggggccatgcacacggccctcaccggcgccaccgagatccagatgagctccggcaacctgctgttcaccgggcacctcaagtgccgcctgcggatggacaagctgcagctcaagggcatgagctactccatgtgcacggggaagttcaaggtggtgaaggagatcgccgagacccagcacggcaccatcgtcatccgcgtgcagtacgagggggacggcagcccgtgcaagatccccttcgagatcatggacctggagaagcggcacgtgctgggccgcctcatcaccgtcaaccccatcgtgacggagaaggactcccccgtcaacatcgaggcggagccgcccttcggggacagctacatcatcatcggcgtggagcccgggcagctgaagctgaactggttcaagaagggcagctccatcgggcagatgttcgagaccaccatgcggggcgccaagcgcatggccatcctcggcgacaccgcctgggacttcgggagctga

SEQ ID NO: 1471 - RNA, 2379 nt, synthetic construct
  misc_feature 1..2379: note = derived and/or modified CDS sequence (opt1) from DENV-2 CYD2-T__C-P2A-SSc-prME
  source 1..2379: mol_type = other RNA
atgaacaaccagcgcaagaaggccaagaacacccccttcaacatgctgaagcgggagcgcaaccgggtgagcaccgtccagcagctcacgaagcgcttctccctgggcatgctgcaggggcggggcccgctcaagctgttcatggccctggtggcgttcctccgcttcctgaccatcccgcccaccgccgggatcctgaagcggtggggcaccatcaagaagtccaaggccatcaacgtgctccgcgggttccggaaggagatcggccgcatgctgaacatcctgaaccggcgccggcgcaacttcgacctcctgaagctggccggcgacgtcgagagcaaccccgggcccagcgccggcatgatcatcatgctcatccccacggtgatggcgttccacctgaccacccggaacggggagccccacatgatcgtgtcccgccaggagaagggcaagagcctgctgttcaagaccgaggacggggtcaacatgtgcacgctgatggccatggacctgggcgagctctgcgaggacaccatcacctacaagtgccccctgctgcggcagaacgagccggaggacatcgactgctggtgcaactccaccagcacgtgggtgacctacgggacctgcaccacgatgggcgagcaccgccgggagaagcgctccgtggccctcgtcccccacgtgggcatggggctggagacccggaccgagacctggatgagctccgagggcgcctggaagcacgtgcagcgcatcgagacgtggatcctgcgccaccccggcttcaccatgatggcggccatcctcgcctacaccatcgggaccacgcacttccagcgggccctgatcttcatcctgctcaccgccgtcacccccagcatgaccatgcgctgcatcggcatgtccaaccgggacttcgtggagggggtgagcggcgggtcctgggtcgacatcgtgctggagcacggcagctgcgtgacgaccatggcgaagaacaagccgaccctggacttcgagctcatcaagaccgaggccaagcagcccgccacgctgcgcaagtactgcatcgaggccaagctgaccaacaccaccacggagtcccggtgccccacccagggcgagcccagcctcaacgaggagcaggacaagcgcttcgtctgcaagcactccatggtggaccgggggtggggcaacgggtgcggcctgttcgggaagggcggcatcgtgacctgcgccatgttccgctgcaagaagaacatggaggggaaggtcgtgcagccggagaacctggagtacaccatcgtgatcacgccccacagcggcgaggagcacgcggtcgggaacgacaccggcaagcacgggaaggagatcaagatcacgccccagagctccatcaccgaggccgagctcaccggctacggcaccgtgaccatggagtgcagcccccggaccgggctggacttcaacgagatggtcctgctccagatggagaacaaggcctggctggtgcaccgccagtggttcctggacctcccgctgccctggctgcccggcgccgacacccaggggtccaactggatccagaaggagacgctcgtgaccttcaagaacccccacgccaagaagcaggacgtcgtggtgctgggcagccaggagggcgcgatgcacaccgccctgaccggggccacggagatccagatgtccagcggcaacctcctcttcaccgggcacctgaagtgccggctgcgcatggacaagctccagctgaagggcatgtcctacagcatgtgcaccgggaagttcaaggtcgtgaaggagatcgccgagacccagcacggcacgatcgtgatccgggtccagtacgagggcgacgggtccccgtgcaagatccccttcgagatcatggacctggagaagcgccacgtgctcggccggctgatcaccgtgaaccccatcgtcaccgagaaggacagccccgtgaacatcgaggccgagccgcccttcggggactcctacatcatcatcggcgtggagcccgggcagctgaagctcaactggttcaagaagggcagctccatcggccagatgttcgagaccacgatgcgcggggcgaagcggatggccatcctgggcgacaccgcctgggacttcgggagcctgggcggggtcttcacctccatcggcaaggccctccaccaggtgttcggcgcgatctacggggccgccttcagcggcgtgtcctggaccatgaagatcctgatcggggtcatcatcacgtggatcggcatgaacagccgctccaccagcctgagcgtgaccctcgtgctggtcgggatcgtgaccctgtacctcggcgtgatggtccaggcctga

SEQ ID NO: 1472 - RNA, 2043 nt, synthetic construct
  misc_feature 1..2043: note = derived and/or modified CDS sequence (opt1) from DENV-2 CYD2-T__SSopt-prME(F108S)
  source 1..2043: mol_type = other RNA
atgaagcgcaagaagtccgccggcatgatcatcatgctgatccccaccgtgatggccttccacctcaccacgcggaacggggagccgcacatgatcgtcagccgccaggagaagggcaagagcctgctgttcaagaccgaggacggggtgaacatgtgcaccctcatggcgatggacctgggcgagctgtgcgaggacaccatcacgtacaagtgccccctcctgcggcagaacgagcccgaggacatcgactgctggtgcaactccaccagcacctgggtgacctacgggacgtgcaccaccatgggcgagcaccgccgggagaagcgctccgtcgccctggtgccccacgtgggcatggggctcgagacccggacggagacctggatgagctccgagggcgcctggaagcacgtccagcgcatcgagacctggatcctgcggcacccggggttcaccatgatggccgccatcctggcgtacacgatcggcaccacccacttccagcgcgccctcatcttcatcctgctgaccgccgtgacgcccagcatgaccatgcggtgcatcgggatgtccaaccgcgacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccggaagtactgcatcgaggccaagctgaccaacacgaccaccgagtcccgctgcccgacccagggggagcccagcctgaacgaggagcaggacaagcggttcgtgtgcaagcactccatggtggaccgcggctggggcaacgggtgcggcctcagcgggaagggcgggatcgtcacgtgcgccatgttccggtgcaagaagaacatggagggcaaggtggtgcagcccgagaacctggagtacaccatcgtcatcacgccccactccggcgaggagcacgccgtggggaacgacaccggcaagcacgggaaggagatcaagatcaccccgcagagctccatcaccgaggcggagctgaccggctacgggaccgtgaccatggagtgcagcccccgcacgggcctcgacttcaacgagatggtcctgctgcagatggagaacaaggcctggctcgtgcaccggcagtggttcctggacctgcccctcccctggctgccgggcgccgacacccaggggagcaactggatccagaaggagaccctggtgaccttcaagaacccccacgccaagaagcaggacgtcgtggtcctcggctcccaggagggggccatgcacacggcgctgaccggcgccaccgagatccagatgagctccgggaacctcctgttcaccggccacctgaagtgccgcctgcggatggacaagctccagctgaagggcatgagctactccatgtgcacggggaagttcaaggtggtgaaggagatcgccgagacccagcacggcaccatcgtcatccgcgtgcagtacgagggggacggcagcccctgcaagatccccttcgagatcatggacctggagaagcgccacgtgctcggccggctgatcaccgtcaacccgatcgtgacggagaaggactcccccgtgaacatcgaggccgagccgcccttcggggacagctacatcatcatcggcgtcgagcccgggcagctgaagctcaactggttcaagaagggctccagcatcgggcagatgttcgagaccaccatgcgcggcgccaagcggatggcgatcctgggcgacaccgcctgggacttcgggtccctgggcggggtgttcacgagcatcggcaaggccctccaccaggtgttcggggccatctacggcgccgcgttctccggcgtcagctggaccatgaagatcctgatcggggtgatcatcacctggatcggcatgaactcccgcagcacctccctgagcgtgacgctggtcctcgtggggatcgtgaccctgtacctgggcgtcatggtgcaggcctga

SEQ ID NO: 1473 - RNA, 2043 nt, synthetic construct
  misc_feature 1..2043: note = derived and/or modified CDS sequence (opt1) from DENV-2 CYD2-T__SSopt-prME(M96H)
  source 1..2043: mol_type = other RNA
atgaagcgcaagaagtccgccggcatgatcatcatgctgatccccaccgtgatggccttccacctcaccacgcggaacggggagccgcacatgatcgtctcccgccaggagaagggcaagagcctgctgttcaagaccgaggacggggtgaacatgtgcaccctcatggcgatggacctgggcgagctgtgcgaggacaccatcacgtacaagtgccccctcctgcggcagaacgagcccgaggacatcgactgctggtgcaactccaccagcacctgggtgacctacgggacgtgcaccaccatgggcgagcaccgccgggagaagcgctccgtcgccctggtgccccacgtgggcatggggctcgagacccggacggagacctggatgagctccgagggcgcctggaagcacgtccagcgcatcgagacctggatcctgcggcacccggggttcaccatgatggccgccatcctggcgtacacgatcggcaccacccacttccagcgcgccctcatcttcatcctgctgaccgccgtgacgcccagcatgaccatgcggtgcatcgggatgtccaaccgcgacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccggaagtactgcatcgaggccaagctgaccaacacgaccaccgagtcccgctgcccgacccagggggagcccagcctgaacgaggagcaggacaagcggttcgtgtgcaagcactcccacgtggaccgcggctggggcaacgggtgcggcctcttcgggaagggcgggatcgtcacgtgcgccatgttccggtgcaagaagaacatggagggcaaggtggtgcagcccgagaacctggagtacaccatcgtcatcacgccccacagcggcgaggagcacgccgtggggaacgacaccggcaagcacgggaaggagatcaagatcaccccgcagtccagcatcaccgaggcggagctgaccggctacgggaccgtgaccatggagtgcagcccccgcacgggcctcgacttcaacgagatggtcctgctgcagatggagaacaaggcctggctcgtgcaccggcagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctcctgttcaccggccacctgaagtgccgcctgcggatggacaagctccagctgaagggcatgtcctacagcatgtgcacggggaagttcaaggtggtgaaggagatcgccgagacccagcacggcaccatcgtcatccgcgtgcagtacgagggggacggctccccctgcaagatccccttcgagatcatggacctggagaagcgccacgtgctcggccggctgatcaccgtcaacccgatcgtgacggagaaggacagccccgtgaacatcgaggccgagccgcccttcggggactcctacatcatcatcggcgtcgagcccgggcagctgaagctcaactggttcaagaagggcagctccatcgggcagatgttcgagaccaccatgcgcggcgccaagcggatggcgatcctgggcgacaccgcctgggacttcgggagcctgggcggggtgttcacgtccatcggcaaggccctccaccaggtgttcggggccatctacggcgccgcgttcagcggcgtctcctggaccatgaagatcctgatcggggtgatcatcacctggatcggcatgaacagccgctccaccagcctgtccgtgacgctggtcctcgtggggatcgtgaccctgtacctgggcgtcatggtgcaggcctga

SEQ ID NO: 1474 - RNA, 2043 nt, synthetic construct
  misc_feature 1..2043: note = derived and/or modified CDS sequence (opt1) from DENV-2 CYD2-T__SSopt-prME(S186F)
  source 1..2043: mol_type = other RNA
atgaagcgcaagaagtccgccggcatgatcatcatgctgatccccaccgtgatggccttccacctcaccacgcggaacggggagccgcacatgatcgtcagccgccaggagaagggcaagagcctgctgttcaagaccgaggacggggtgaacatgtgcaccctcatggcgatggacctgggcgagctgtgcgaggacaccatcacgtacaagtgccccctcctgcggcagaacgagcccgaggacatcgactgctggtgcaactccaccagcacctgggtgacctacgggacgtgcaccaccatgggcgagcaccgccgggagaagcgctccgtcgccctggtgccccacgtgggcatggggctcgagacccggacggagacctggatgagctccgagggcgcctggaagcacgtccagcgcatcgagacctggatcctgcggcacccggggttcaccatgatggccgccatcctggcgtacacgatcggcaccacccacttccagcgcgccctcatcttcatcctgctgaccgccgtgacgcccagcatgaccatgcggtgcatcgggatgtccaaccgcgacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccggaagtactgcatcgaggccaagctgaccaacacgaccaccgagtcccgctgcccgacccagggggagcccagcctgaacgaggagcaggacaagcggttcgtgtgcaagcactccatggtggaccgcggctggggcaacgggtgcggcctcttcgggaagggcgggatcgtcacgtgcgccatgttccggtgcaagaagaacatggagggcaaggtggtgcagcccgagaacctggagtacaccatcgtcatcacgccccacagcggcgaggagcacgccgtggggaacgacaccggcaagcacgggaaggagatcaagatcaccccgcagtccagcatcaccgaggcggagctgaccggctacgggaccgtgaccatggagtgcttcccccgcacgggcctcgacttcaacgagatggtcctgctgcagatggagaacaaggcctggctcgtgcaccggcagtggttcctggacctgcccctcccctggctgccgggcgccgacacccaggggtccaactggatccagaaggagaccctggtgaccttcaagaacccccacgccaagaagcaggacgtcgtggtcctcggcagccaggagggggccatgcacacggcgctgaccggcgccaccgagatccagatgagctccgggaacctcctgttcaccggccacctgaagtgccgcctgcggatggacaagctccagctgaagggcatgagctactccatgtgcacggggaagttcaaggtggtgaaggagatcgccgagacccagcacggcaccatcgtcatccgcgtgcagtacgagggggacggcagcccctgcaagatccccttcgagatcatggacctggagaagcgccacgtgctcggccggctgatcaccgtcaacccgatcgtgacggagaaggactcccccgtgaacatcgaggccgagccgcccttcggggacagctacatcatcatcggcgtcgagcccgggcagctgaagctcaactggttcaagaagggctccagcatcgggcagatgttcgagaccaccatgcgcggcgccaagcggatggcgatcctgggcgacaccgcctgggacttcgggtccctgggcggggtgttcacgagcatcggcaaggccctccaccaggtgttcggggccatctacggcgccgcgttctccggcgtcagctggaccatgaagatcctgatcggggtgatcatcacctggatcggcatgaactcccgcagcacctccctgagcgtgacgctggtcctcgtggggatcgtgaccctgtacctgggcgtcatggtgcaggcctga

SEQ ID NO: 1475 - RNA, 2043 nt, synthetic construct
  misc_feature 1..2043: note = derived and/or modified CDS sequence (opt1) from DENV-2 CYD2-T__SSopt-prME(R188L)
  source 1..2043: mol_type = other RNA
atgaagcgcaagaagtccgccggcatgatcatcatgctgatccccaccgtgatggccttccacctcaccacgcggaacggggagccgcacatgatcgtctcccgccaggagaagggcaagagcctgctgttcaagaccgaggacggggtgaacatgtgcaccctcatggcgatggacctgggcgagctgtgcgaggacaccatcacgtacaagtgccccctcctgcggcagaacgagcccgaggacatcgactgctggtgcaactccaccagcacctgggtgacctacgggacgtgcaccaccatgggcgagcaccgccgggagaagcgctccgtcgccctggtgccccacgtgggcatggggctcgagacccggacggagacctggatgagctccgagggcgcctggaagcacgtccagcgcatcgagacctggatcctgcggcacccggggttcaccatgatggccgccatcctggcgtacacgatcggcaccacccacttccagcgcgccctcatcttcatcctgctgaccgccgtgacgcccagcatgaccatgcggtgcatcgggatgtccaaccgcgacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccggaagtactgcatcgaggccaagctgaccaacacgaccaccgagtcccgctgcccgacccagggggagcccagcctgaacgaggagcaggacaagcggttcgtgtgcaagcactccatggtggaccgcggctggggcaacgggtgcggcctcttcgggaagggcgggatcgtcacgtgcgccatgttccggtgcaagaagaacatggagggcaaggtggtgcagcccgagaacctggagtacaccatcgtcatcacgccccacagcggcgaggagcacgccgtggggaacgacaccggcaagcacgggaaggagatcaagatcaccccgcagtccagcatcaccgaggcggagctgaccggctacgggaccgtgaccatggagtgcagccccctcacgggcctggacttcaacgagatggtcctgctccagatggagaacaaggcctggctggtgcaccgccagtggttcctggacctccccctgccctggctgccgggcgccgacacccaggggagcaactggatccagaaggagaccctcgtgaccttcaagaacccccacgccaagaagcaggacgtcgtggtcctgggcagccaggagggggccatgcacacggcgctgaccggcgccaccgagatccagatgtccagcgggaacctcctgttcaccggccacctgaagtgccggctccgcatggacaagctgcagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctcgagaagcgccacgtgctgggccgcctgatcaccgtcaacccgatcgtgacggagaaggacagccccgtgaacatcgaggccgagccgcccttcggggactcctacatcatcatcggcgtcgagcccgggcagctcaagctgaactggttcaagaagggcagctccatcgggcagatgttcgagaccaccatgcggggcgccaagcgcatggcgatcctgggcgacaccgcctgggacttcgggagcctcggcggggtgttcacgtccatcggcaaggccctgcaccaggtgttcggggccatctacggcgccgcgttcagcggcgtctcctggaccatgaagatcctgatcggggtgatcatcacctggatcggcatgaacagccggtccaccagcctgtccgtgacgctcgtcctggtggggatcgtgaccctgtacctcggcgtcatggtgcaggcctga

SEQ ID NO: 1476 - RNA, 2043 nt, synthetic construct
  misc_feature 1..2043: note = derived and/or modified CDS sequence (opt1) from DENV-2 CYD2-T__SSopt-pr(D104A)MEdelstem_TM,(F108S)-JEV
  source 1..2043: mol_type = other RNA
atgaagcgcaagaagtccgccggcatgatcatcatgctgatccccaccgtgatggccttccacctcaccacgcggaacggggagccgcacatgatcgtcagccgccaggagaagggcaagagcctgctgttcaagaccgaggacggggtgaacatgtgcaccctcatggcgatggacctgggcgagctgtgcgaggacaccatcacgtacaagtgccccctcctgcggcagaacgagcccgaggacatcgactgctggtgcaactccaccagcacctgggtgacctacgggacgtgcaccaccatgggcgagcaccgccgggccaagcgctccgtcgccctggtgccccacgtgggcatggggctcgagacccggacggagacctggatgagctccgagggcgcctggaagcacgtccagcgcatcgagacctggatcctgcggcacccggggttcaccatgatggccgcgatcctggcctacacgatcggcaccacccacttccagcgcgccctcatcttcatcctgctgaccgccgtgacgcccagcatgaccatgcggtgcatcgggatgtccaaccgcgacttcgtggagggcgtcagcggcgggtcctgggtggacatcgtgctcgagcacggcagctgcgtcaccaccatggcgaagaacaagcccacgctggacttcgagctgatcaagaccgaggccaagcagcccgccaccctccggaagtactgcatcgaggccaagctgaccaacacgaccaccgagtcccgctgcccgacccagggggagcccagcctgaacgaggagcaggacaagcggttcgtgtgcaagcactccatggtggaccgcggctggggcaacgggtgcggcctcagcgggaagggcgggatcgtcacgtgcgccatgttccggtgcaagaagaacatggagggcaaggtggtgcagcccgagaacctggagtacaccatcgtcatcacgccccactccggcgaggagcacgcggtggggaacgacaccggcaagcacgggaaggagatcaagatcaccccgcagagctccatcaccgaggccgagctgaccggctacgggaccgtgaccatggagtgcagcccccgcacgggcctcgacttcaacgagatggtcctgctgcagatggagaacaaggcctggctcgtgcaccggcagtggttcctggacctgcccctcccctggctgccgggcgccgacacccaggggagcaactggatccagaaggagaccctggtgaccttcaagaacccccacgccaagaagcaggacgtcgtggtcctcggctcccaggagggggcgatgcacacggccctgaccggcgccaccgagatccagatgagctccgggaacctcctgttcaccggccacctgaagtgccgcctgcggatggacaagctccagctgaagggcatgagctactccatgtgcacggggaagttcaaggtggtgaaggagatcgccgagacccagcacggcaccatcgtcatccgcgtgcagtacgagggggacggcagcccctgcaagatccccttcgagatcatggacctggagaagcgccacgtgctcggccggctgatcaccgtcaacccgatcgtgacggagaaggactcccccgtgaacatcgaggccgagccgcccttcggggacagctacatcatcatcggcgtcgagcccgggcagctgaagctcaactggttcaagaagggctccaccctggggaaggcgttcagcaccaccctgaagggcgcccagcgcctcgccgccctgggcgacacggcctgggacttcgggtccatcggcggggtgttcaacagcatcggccgggcggtgcaccaggtcttcgggggcgccttccgcaccctgttcggcgggatgtcctggatcacccagggcctgatgggggccctcctgctgtggatgggcgtgaacgcccgggaccgcagcatcgcgctcgccttcctggccaccgggggcgtgctggtcttcctcgccacgaacgtgcacgcctga

SEQ ID NO: 1477 - RNA, 2043 nt, synthetic construct
  misc_feature 1..2043: note = derived and/or modified CDS sequence (opt1) from DENV-2 CYD2-T__SSopt-prMEdelstem_TM,(H261N)-JEV
  source 1..2043: mol_type = other RNA
atgaagcgcaagaagtccgccggcatgatcatcatgctgatccccaccgtgatggccttccacctcaccacgcggaacggggagccgcacatgatcgtctcccgccaggagaagggcaagagcctgctgttcaagaccgaggacggggtgaacatgtgcaccctcatggcgatggacctgggcgagctgtgcgaggacaccatcacgtacaagtgccccctcctgcggcagaacgagcccgaggacatcgactgctggtgcaactccaccagcacctgggtgacctacgggacgtgcaccaccatgggcgagcaccgccgggagaagcgctccgtcgccctggtgccccacgtgggcatggggctcgagacccggacggagacctggatgagctccgagggcgcctggaagcacgtccagcgcatcgagacctggatcctgcggcacccggggttcaccatgatggccgccatcctggcgtacacgatcggcaccacccacttccagcgcgccctcatcttcatcctgctgaccgccgtgacgcccagcatgaccatgcggtgcatcgggatgtccaaccgcgacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccggaagtactgcatcgaggccaagctgaccaacacgaccaccgagtcccgctgcccgacccagggggagcccagcctgaacgaggagcaggacaagcggttcgtgtgcaagcactccatggtggaccgcggctggggcaacgggtgcggcctcttcgggaagggcgggatcgtcacgtgcgccatgttccggtgcaagaagaacatggagggcaaggtggtgcagcccgagaacctggagtacaccatcgtcatcacgccccacagcggcgaggagcacgccgtggggaacgacaccggcaagcacgggaaggagatcaagatcaccccgcagtccagcatcaccgaggcggagctgaccggctacgggaccgtgaccatggagtgcagcccccgcacgggcctcgacttcaacgagatggtcctgctgcagatggagaacaaggcctggctcgtgcaccggcagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgaacacggcgctgaccggcgccaccgagatccagatgtccagcgggaacctcctgttcaccggccacctgaagtgccgcctgcggatggacaagctccagctgaagggcatgtcctacagcatgtgcacggggaagttcaaggtggtgaaggagatcgccgagacccagcacggcaccatcgtcatccgcgtgcagtacgagggggacggctccccctgcaagatccccttcgagatcatggacctggagaagcgccacgtgctcggccggctgatcaccgtcaacccgatcgtgacggagaaggacagccccgtgaacatcgaggccgagccgcccttcggggactcctacatcatcatcggcgtcgagcccgggcagctgaagctcaactggttcaagaagggcagcaccctggggaaggccttctccaccaccctgaagggcgcgcagcgcctcgccgccctgggcgacacggcctgggacttcgggagcatcggcggggtgttcaactccatcggccgggccgtgcaccaggtcttcgggggcgcgttccgcaccctgttcggcgggatgagctggatcacccagggcctgatgggggccctcctgctgtggatgggcgtgaacgcccgggaccgctccatcgccctcgcgttcctggccaccgggggcgtgctggtcttcctcgccacgaacgtgcacgcctga

SEQ ID NO: 1478 - RNA, 2043 nt, synthetic construct
  misc_feature 1..2043: note = derived and/or modified CDS sequence (opt1) from DENV-2 CYD2-T__SSopt-prMEdelstem_TM,(R188L,A267T)-JEV
  source 1..2043: mol_type = other RNA
atgaagcgcaagaagtccgccggcatgatcatcatgctgatccccaccgtgatggccttccacctcaccacgcggaacggggagccgcacatgatcgtctcccgccaggagaagggcaagagcctgctgttcaagaccgaggacggggtgaacatgtgcaccctcatggcgatggacctgggcgagctgtgcgaggacaccatcacgtacaagtgccccctcctgcggcagaacgagcccgaggacatcgactgctggtgcaactccaccagcacctgggtgacctacgggacgtgcaccaccatgggcgagcaccgccgggagaagcgctccgtcgccctggtgccccacgtgggcatggggctcgagacccggacggagacctggatgagctccgagggcgcctggaagcacgtccagcgcatcgagacctggatcctgcggcacccggggttcaccatgatggccgccatcctggcgtacacgatcggcaccacccacttccagcgcgccctcatcttcatcctgctgaccgccgtgacgcccagcatgaccatgcggtgcatcgggatgtccaaccgcgacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccggaagtactgcatcgaggccaagctgaccaacacgaccaccgagtcccgctgcccgacccagggggagcccagcctgaacgaggagcaggacaagcggttcgtgtgcaagcactccatggtggaccgcggctggggcaacgggtgcggcctcttcgggaagggcgggatcgtcacgtgcgccatgttccggtgcaagaagaacatggagggcaaggtggtgcagcccgagaacctggagtacaccatcgtcatcacgccccacagcggcgaggagcacgccgtggggaacgacaccggcaagcacgggaaggagatcaagatcacgccgcagtccagcatcaccgaggcggagctgaccggctacgggaccgtgaccatggagtgcagccccctcacgggcctggacttcaacgagatggtcctgctccagatggagaacaaggcctggctggtgcaccgccagtggttcctggacctccccctgccctggctgccgggcgccgacacccaggggagcaactggatccagaaggagaccctcgtgaccttcaagaacccccacgccaagaagcaggacgtcgtggtcctgggcagccaggagggggccatgcacacggcgctgaccggcaccaccgagatccagatgtccagcgggaacctcctgttcacgggccacctgaagtgccggctccgcatggacaagctgcagctgaagggcatgtcctacagcatgtgcaccgggaagttcaaggtggtgaaggagatcgccgagacccagcacggcaccatcgtcatccgggtgcagtacgagggggacggctccccctgcaagatccccttcgagatcatggacctcgagaagcgccacgtgctgggccgcctgatcacggtcaacccgatcgtgaccgagaaggacagccccgtgaacatcgaggccgagccgcccttcggggactcctacatcatcatcggcgtcgagcccgggcagctcaagctgaactggttcaagaagggcagcaccctggggaaggccttctccaccacgctcaagggcgcccagcggctggcggccctgggcgacaccgcctgggacttcgggagcatcggcggggtgttcaactccatcggccgcgccgtgcaccaggtcttcgggggcgccttccggaccctgttcggcgggatgagctggatcacccagggcctcatgggggcgctgctgctctggatgggcgtgaacgcccgcgaccggtccatcgccctggccttcctggcgaccgggggcgtgctcgtcttcctggccaccaacgtgcacgcctga

SEQ ID NO: 1479 - RNA, 297 nt, synthetic construct
  misc_feature 1..297: note = derived and/or modified CDS sequence (opt1) from DENV-4 Consensus__C
  source 1..297: mol_type = other RNA
atgaaccagcgcaagaaggtggtccggcccccgttcaacatgctgaagcgcgagcggaaccgcgtgagcacgccccagggcctcgtgaagcggttctccaccgggctgttcagcggcaaggggcccctgcgcatggtcctcgccttcatcaccttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgc

SEQ ID NO: 1480 - RNA, 339 nt, synthetic construct
  misc_feature 1..339: note = derived and/or modified CDS sequence (opt1) from DENV-4 Consensus__C-SSc
  source 1..339: mol_type = other RNA
atgaaccagcgcaagaaggtggtccggcccccgttcaacatgctgaagcgcgagcggaaccgcgtgagcacgccccagggcctcgtgaagcggttctccaccgggctgttcagcggcaaggggcccctgcgcatggtcctcgccttcatcaccttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgcagcaccatcaccctgctctgcctgatccccacggtgatggcc

SEQ ID NO: 1481 - RNA, 273 nt, synthetic construct
  misc_feature 1..273: note = derived and/or modified CDS sequence (opt1) from DENV-4 Consensus__pr
  source 1..273: mol_type = other RNA
ttccacctgagcacccgcgacggcgagcccctcatgatcgtggccaagcacgagcgggggcgcccgctgctgttcaagaccacggagggcatcaacaagtgcaccctcatcgccatggacctgggggagatgtgcgaggacaccgtcacctacaagtgccccctgctcgtgaacacggagcccgaggacatcgactgctggtgcaacctgacctccacctgggtgatgtacgggacctgcacgcagagcggcgagcggcgccgggagaagcgc

SEQ ID NO: 1482 - RNA, 225 nt, synthetic construct
  misc_feature 1..225: note = derived and/or modified CDS sequence (opt1) from DENV-4 Consensus__M
  source 1..225: mol_type = other RNA
agcgtggccctgacgccccactccggcatggggctcgagacccgcgccgagacctggatgagctccgagggcgcgtggaagcacgcccagcgggtcgagagctggatcctgcgcaacccggggttcgccctgctcgccggcttcatggcctacatgatcgggcagaccggcatccagcggaccgtgttcttcgtgctgatgatgctggtcgcgccctcctacggc

SEQ ID NO: 1483 - RNA, 498 nt, synthetic construct
  misc_feature 1..498: note = derived and/or modified CDS sequence (opt1) from DENV-4 Consensus__prM
  source 1..498: mol_type = other RNA
ttccacctgagcacccgcgacggcgagcccctcatgatcgtggccaagcacgagcgggggcgcccgctgctgttcaagaccacggagggcatcaacaagtgcaccctcatcgccatggacctgggggagatgtgcgaggacaccgtcacctacaagtgccccctgctcgtgaacacggagcccgaggacatcgactgctggtgcaacctgacctccacctgggtgatgtacgggacctgcacgcagagcggcgagcggcgccgggagaagcgctccgtcgcgctgacgccccacagcggcatgggcctcgagacccgggccgagacctggatgtccagcgagggggcctggaagcacgcccagcgcgtggagtcctggatcctgcggaacccgggcttcgccctgctcgcggggttcatggcctacatgatcggccagaccgggatccagcgcaccgtgttcttcgtcctgatgatgctggtggcccccagctacggc

SEQ ID NO: 1484 - RNA, 1485 nt, synthetic construct
  misc_feature 1..1485: note = derived and/or modified CDS sequence (opt1) from DENV-4 Consensus__E
  source 1..1485: mol_type = other RNA
atgcgctgcgtgggcgtcgggaaccgggacttcgtggagggcgtgagcgggggcgcctgggtcgacctggtgctcgagcacgggggctgcgtgaccaccatggcccagggcaagcccacgctggacttcgagctgaccaagaccaccgcgaaggaggtcgccctcctgcgcacgtactgcatcgaggcctccatcagcaacatcaccaccgccacccggtgcccgacgcagggggagccctacctgaaggaggagcaggaccagcagtacatctgccgccgggacgtggtggaccgcggctgggggaacggctgcggcctcttcgggaagggcggggtcgtgacctgcgccaagttctcctgcagcggcaagatcaccgggaacctggtgcagatcgagaacctggagtacaccgtcgtggtgacggtccacaacggcgacacccacgcggtgggcaacgacacctccaaccacggggtgaccgccacgatcacgccccggagcccctccgtcgaggtgaagctcccggactacggcgagctgaccctggactgcgagccccgcagcgggatcgacttcaacgagatgatcctcatgaagatgaagaagaagacctggctggtgcacaagcagtggttcctggacctccccctgccctggaccgccggcgccgacacctccgaggtccactggaactacaaggagcggatggtgaccttcaaggtgccgcacgcgaagcgccaggacgtcaccgtgctggggagccaggagggcgccatgcactccgccctcgccggcgccacggaggtcgacagcggggacggcaaccacatgttcgcggggcacctgaagtgcaaggtgcggatggagaagctgcgcatcaagggcatgtcctacaccatgtgcagcgggaagttctccatcgacaaggagatggccgagacccagcacggcaccacggtggtcaaggtgaagtacgagggcgccggggccccctgcaaggtgcccatcgagatccgggacgtcaacaaggagaaggtggtgggccgcgtcatcagctccacgcccctcgccgagaacaccaacagcgtgaccaacatcgagctggagccgcccttcggggactcctacatcgtgatcggcgtcgggaacagcgcgctgaccctccactggttccggaagggcagctccatcggcaagatgttcgagagcacctaccgcggggccaagcggatggccatcctgggcgagaccgcctgggacttcgggtccgtgggcggcctgttcaccagcctcgggaaggccgtgcaccaggtcttcggctccgtgtacacgaccatgttcgggggcgtgagctggatgatccgcatcctgatcgggttcctggtcctctggatcggcaccaactcccggaacaccagcatggcgatgacctgcatcgccgtgggcgggatcacgctgttcctgggcttcaccgtgcaggcc

SEQ ID NO: 1485 - RNA, 1983 nt, synthetic construct
  misc_feature 1..1983: note = derived and/or modified CDS sequence (opt1) from DENV-4 Consensus__prME
  source 1..1983: mol_type = other RNA
ttccacctgagcacccgcgacggcgagcccctcatgatcgtggccaagcacgagcgggggcgcccgctgctgttcaagaccacggagggcatcaacaagtgcaccctcatcgccatggacctgggggagatgtgcgaggacaccgtcacctacaagtgccccctgctcgtgaacacggagcccgaggacatcgactgctggtgcaacctgacctccacctgggtgatgtacgggacctgcacgcagagcggcgagcggcgccgggagaagcgctccgtcgcgctgacgccccacagcggcatgggcctcgagacccgggccgagacctggatgtccagcgagggggcctggaagcacgcccagcgcgtggagtcctggatcctgcggaacccgggcttcgccctgctcgcggggttcatggcctacatgatcggccagaccgggatccagcgcaccgtgttcttcgtcctgatgatgctggtggcccccagctacggcatgcggtgcgtgggcgtcgggaaccgcgacttcgtggagggcgtgtccgggggcgcctgggtcgacctcgtgctggagcacggcgggtgcgtgaccaccatggcgcagggcaagcccacgctggacttcgagctcaccaagaccaccgccaaggaggtcgccctgctgcggacgtactgcatcgaggccagcatctccaacatcaccaccgccacccgctgccccacgcagggggagccgtacctcaaggaggagcaggaccagcagtacatctgccggcgcgacgtggtggaccggggctgggggaacggctgcggcctgttcgggaagggcggggtcgtgacctgcgcgaagttcagctgctccggcaagatcaccgggaacctggtgcagatcgagaacctcgagtacaccgtcgtggtgacggtccacaacggcgacacccacgccgtgggcaacgacaccagcaaccacggggtcaccgccacgatcacgccccgctcccccagcgtggaggtgaagctgcccgactacggcgagctgaccctcgactgcgagccgcggtccgggatcgacttcaacgagatgatcctgatgaagatgaagaagaagacctggctggtccacaagcagtggttcctcgacctgcccctgccctggaccgccggcgccgacaccagcgaggtgcactggaactacaaggagcgcatggtgaccttcaaggtcccccacgcgaagcggcaggacgtgaccgtgctcgggtcccaggagggcgccatgcacagcgccctggccggcgccaccgaggtcgacagcggggacggcaaccacatgttcgcggggcacctgaagtgcaaggtgcgcatggagaagctccgcatcaagggcatgtcctacacgatgtgcagcggcaagttctccatcgacaaggagatggccgagacccagcacgggaccaccgtggtcaaggtgaagtacgagggcgccggggccccgtgcaaggtgcccatcgagatccgggacgtcaacaaggagaaggtggtgggccgcgtcatcagctccacgcccctggccgagaacaccaacagcgtgaccaacatcgagctggagcccccgttcggggactcctacatcgtgatcggcgtcggcaacagcgcgctcaccctgcactggttccggaaggggtccagcatcggcaagatgttcgagtccacgtaccgcggggccaagcggatggccatcctgggcgagaccgcctgggacttcgggagcgtgggcggcctcttcacctccctggggaaggcggtgcaccaggtcttcggcagcgtgtacaccacgatgttcgggggcgtgtcctggatgatccgcatcctgatcgggttcctcgtcctgtggatcggcaccaacagccggaacacctccatggccatgacctgcatcgccgtgggcgggatcacgctgttcctcggcttcaccgtgcaggcc

SEQ ID NO: 1486 - RNA, 2025 nt, synthetic construct
  misc_feature 1..2025: note = derived and/or modified CDS sequence (opt1) from DENV-4 Consensus__SSc-prME
  source 1..2025: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggcgagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacgcccctggcggagaacaccaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggcc

SEQ ID NO: 1487 - RNA, 2322 nt, synthetic construct
  misc_feature 1..2322: note = derived and/or modified CDS sequence (opt1) from DENV-4 Consensus__C-prME
  source 1..2322: mol_type = other RNA
atgaaccagcgcaagaaggtggtccggccgcccttcaacatgctgaagcgcgagcggaaccgcgtgagcacgccccagggcctcgtgaagcggttctccaccgggctgttcagcggcaaggggcccctgcgcatggtcctcgccttcatcaccttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgcagcaccatcaccctgctctgcctgatccccacggtgatggccttccacctgtccacccgggacggcgagcccctcatgatcgtcgccaagcacgagcgcgggcggcccctgctgttcaagaccaccgagggcatcaacaagtgcacgctcatcgccatggacctgggggagatgtgcgaggacaccgtgacctacaagtgcccgctgctcgtgaacaccgagcccgaggacatcgactgctggtgcaacctgacgagcacctgggtcatgtacgggacctgcacccagtccggcgagcgccggcgcgagaagcggagcgtggccctgacgccccactccggcatgggcctcgagacccgcgcggagacctggatgagctccgagggggcctggaagcacgcccagcgggtggagagctggatcctgcgcaaccccggcttcgccctgctcgcgggcttcatggcctacatgatcgggcagaccggcatccagcgcacggtcttcttcgtgctgatgatgctggtggccccctcctacgggatgcggtgcgtcggcgtggggaaccgcgacttcgtggagggcgtcagcggcggggcctgggtggacctcgtgctggagcacggcgggtgcgtcaccaccatggcccagggcaagcccaccctggacttcgagctcacgaagaccaccgcgaaggaggtggccctgctgcggacctactgcatcgaggcctccatcagcaacatcacgaccgccacccgctgccccacccagggggagccctacctcaaggaggagcaggaccagcagtacatctgccggcgcgacgtggtcgaccggggctggggcaacgggtgcggcctgttcgggaagggcggggtggtcacgtgcgccaagttctcctgcagcggcaagatcaccggcaacctggtgcagatcgagaacctcgagtacaccgtggtcgtgaccgtgcacaacggggacacgcacgcggtcggcaacgacacctccaaccacggggtgaccgccaccatcaccccgcgcagccccagcgtggaggtcaagctgcccgactacggcgagctgacgctcgactgcgagccccggtccggcatcgacttcaacgagatgatcctgatgaagatgaagaagaagacctggctggtgcacaagcagtggttcctcgacctgccgctgccctggaccgccggggccgacaccagcgaggtgcactggaactacaaggagcgcatggtcacgttcaaggtgccccacgccaagcggcaggacgtgaccgtcctcggctcccaggagggggcgatgcacagcgccctggccggcgccaccgaggtggactccggggacggcaaccacatgttcgccggccacctgaagtgcaaggtgcgcatggagaagctgcggatcaaggggatgagctacaccatgtgctccggcaagttcagcatcgacaaggagatggcggagacgcagcacgggaccaccgtcgtgaaggtgaagtacgagggcgccggggccccctgcaaggtcccgatcgagatccgcgacgtgaacaaggagaaggtggtcggccgggtgatctccagcacgcccctcgccgagaacaccaactccgtgaccaacatcgagctggagccgcccttcggcgacagctacatcgtcatcggggtgggcaactccgcgctgaccctccactggttccgcaaggggagctccatcggcaagatgttcgagagcacctaccgcggggccaagcggatggccatcctgggcgagacggcctgggacttcggctccgtcgggggcctgttcaccagcctcgggaaggccgtgcaccaggtgttcggctccgtgtacaccaccatgttcgggggcgtcagctggatgatccggatcctgatcggcttcctggtgctctggatcgggacgaacagccgcaacacctccatggcgatgacctgcatcgccgtgggcgggatcaccctgttcctgggcttcacggtccaggcc

SEQ ID NO: 1488 - RNA, 45 nt, synthetic construct; identical to SEQ ID NO: 1332
  misc_feature 1..45: note = derived and/or modified CDS sequence (opt1) from DENV-4 Consensus__SSc
  source 1..45: mol_type = other RNA

SEQ ID NO: 1489 - RNA, 57 nt, synthetic construct; identical to SEQ ID NO: 1333
  misc_feature 1..57: note = derived and/or modified CDS sequence (opt1) from DENV-4 Consensus__SSopt
  source 1..57: mol_type = other RNA

SEQ ID NO: 1490 - RNA, 57 nt, synthetic construct
  misc_feature 1..57: note = derived and/or modified CDS sequence (opt1) from DENV-4 Consensus__SSm
  source 1..57: mol_type = other RNA
atgatccagcgcaccgtgttcttcgtcctgatgatgctcgtggcccccagctacggc

SEQ ID NO: 1491 - RNA, 1488 nt, synthetic construct
  misc_feature 1..1488: note = derived and/or modified CDS sequence (opt1) from DENV-4 Consensus__E
  source 1..1488: mol_type = other RNA
atgcgctgcgtgggcgtcgggaaccgggacttcgtggagggcgtgagcgggggcgcctgggtcgacctggtgctcgagcacgggggctgcgtgaccaccatggcccagggcaagcccacgctggacttcgagctgaccaagaccaccgcgaaggaggtcgccctcctgcgcacgtactgcatcgaggcctccatcagcaacatcaccaccgccacccggtgcccgacgcagggggagccctacctgaaggaggagcaggaccagcagtacatctgccgccgggacgtggtggaccgcggctgggggaacggctgcggcctcttcgggaagggcggggtcgtgacctgcgccaagttctcctgcagcggcaagatcaccgggaacctggtgcagatcgagaacctggagtacaccgtcgtggtgacggtccacaacggcgacacccacgcggtgggcaacgacacctccaaccacggggtgaccgccacgatcacgccccggagcccctccgtcgaggtgaagctcccggactacggcgagctgaccctggactgcgagccccgcagcgggatcgacttcaacgagatgatcctcatgaagatgaagaagaagacctggctggtgcacaagcagtggttcctggacctccccctgccctggaccgccggcgccgacacctccgaggtccactggaactacaaggagcggatggtgaccttcaaggtgccgcacgcgaagcgccaggacgtcaccgtgctggggagccaggagggcgccatgcactccgccctcgccggcgccacggaggtcgacagcggggacggcaaccacatgttcgcggggcacctgaagtgcaaggtgcggatggagaagctgcgcatcaagggcatgtcctacaccatgtgcagcgggaagttctccatcgacaaggagatggccgagacccagcacggcaccacggtggtcaaggtgaagtacgagggcgccggggccccctgcaaggtgcccatcgagatccgggacgtcaacaaggagaaggtggtgggccgcgtcatcagctccacgcccctcgccgagaacaccaacagcgtgaccaacatcgagctggagccgcccttcggggactcctacatcgtgatcggcgtcgggaacagcgcgctgaccctccactggttccggaagggcagctccatcggcaagatgttcgagagcacctaccgcggggccaagcggatggccatcctgggcgagaccgcctgggacttcgggtccgtgggcggcctgttcaccagcctcgggaaggccgtgcaccaggtcttcggctccgtgtacacgaccatgttcgggggcgtgagctggatgatccgcatcctgatcgggttcctggtcctctggatcggcaccaactcccggaacaccagcatggcgatgacctgcatcgccgtgggcgggatcacgctgttcctgggcttcaccgtgcaggcctga

SEQ ID NO: 1492 - RNA, 1182 nt, synthetic construct
  misc_feature 1..1182: note = derived and/or modified CDS sequence (opt1) from DENV-4 Consensus__EdelTM-variant (aa1-394)
  source 1..1182: mol_type = other RNA
atgcgctgcgtgggcgtcgggaaccgggacttcgtggagggcgtgagcgggggcgcctgggtcgacctggtgctcgagcacgggggctgcgtgaccaccatggcccagggcaagcccacgctggacttcgagctgaccaagaccaccgcgaaggaggtcgccctcctgcgcacgtactgcatcgaggcctccatcagcaacatcaccaccgccacccggtgcccgacgcagggggagccctacctgaaggaggagcaggaccagcagtacatctgccgccgggacgtggtggaccgcggctgggggaacggctgcggcctcttcgggaagggcggggtcgtgacctgcgccaagttctcctgcagcggcaagatcaccgggaacctggtgcagatcgagaacctggagtacaccgtcgtggtgacggtccacaacggcgacacccacgcggtgggcaacgacacctccaaccacggggtgaccgccacgatcacgccccggagcccctccgtcgaggtgaagctcccggactacggcgagctgaccctggactgcgagccccgcagcgggatcgacttcaacgagatgatcctcatgaagatgaagaagaagacctggctggtgcacaagcagtggttcctggacctccccctgccctggaccgccggcgccgacacctccgaggtccactggaactacaaggagcggatggtgaccttcaaggtgccgcacgcgaagcgccaggacgtcaccgtgctggggagccaggagggcgccatgcactccgccctcgccggcgccacggaggtcgacagcggggacggcaaccacatgttcgcggggcacctgaagtgcaaggtgcggatggagaagctgcgcatcaagggcatgtcctacaccatgtgcagcgggaagttctccatcgacaaggagatggccgagacccagcacggcaccacggtggtcaaggtgaagtacgagggcgccggggccccctgcaaggtgcccatcgagatccgggacgtcaacaaggagaaggtggtgggccgcgtcatcagctccacgcccctcgccgagaacaccaacagcgtgaccaacatcgagctggagccgcccttcggggactcctacatcgtgatcggcgtcgggaacagcgcgctgaccctccactggttccggaag

SEQ ID NO: 1493 - RNA, 1272 nt, synthetic construct
  misc_feature 1..1272: note = derived and/or modified CDS sequence (opt1) from DENV-4 Consensus__EdelTM-variant (aa1-424)
  source 1..1272: mol_type = other RNA
atgcgctgcgtgggcgtcgggaaccgggacttcgtggagggcgtgagcgggggcgcctgggtcgacctggtgctcgagcacgggggctgcgtgaccaccatggcccagggcaagcccacgctggacttcgagctgaccaagaccaccgcgaaggaggtcgccctcctgcgcacgtactgcatcgaggcctccatcagcaacatcaccaccgccacccggtgcccgacgcagggggagccctacctgaaggaggagcaggaccagcagtacatctgccgccgggacgtggtggaccgcggctgggggaacggctgcggcctcttcgggaagggcggggtcgtgacctgcgccaagttctcctgcagcggcaagatcaccgggaacctggtgcagatcgagaacctggagtacaccgtcgtggtgacggtccacaacggcgacacccacgcggtgggcaacgacacctccaaccacggggtgaccgccacgatcacgccccggagcccctccgtcgaggtgaagctcccggactacggcgagctgaccctggactgcgagccccgcagcgggatcgacttcaacgagatgatcctcatgaagatgaagaagaagacctggctggtgcacaagcagtggttcctggacctccccctgccctggaccgccggcgccgacacctccgaggtccactggaactacaaggagcggatggtgaccttcaaggtgccgcacgcgaagcgccaggacgtcaccgtgctggggagccaggagggcgccatgcactccgccctcgccggcgccacggaggtcgacagcggggacggcaaccacatgttcgcggggcacctgaagtgcaaggtgcggatggagaagctgcgcatcaagggcatgtcctacaccatgtgcagcgggaagttctccatcgacaaggagatggccgagacccagcacggcaccacggtggtcaaggtgaagtacgagggcgccggggccccctgcaaggtgcccatcgagatccgggacgtcaacaaggagaaggtggtgggccgcgtcatcagctccacgcccctcgccgagaacaccaacagcgtgaccaacatcgagctggagccgcccttcggggactcctacatcgtgatcggcgtcgggaacagcgcgctgaccctccactggttccggaagggcagctccatcggcaagatgttcgagagcacctaccgcggggccaagcggatggccatcctgggcgagaccgcctgggacttcgggtcc

SEQ ID NO: 1494 - RNA, 1266 nt, synthetic construct
  misc_feature 1..1266: note = derived and/or modified CDS sequence (opt1) from DENV-4 Consensus__EdelTM-variant (aa1-421)
  source 1..1266: mol_type = other RNA
atgcgctgcgtgggcgtcgggaaccgggacttcgtggagggcgtgagcgggggcgcctgggtcgacctggtgctcgagcacgggggctgcgtgaccaccatggcccagggcaagcccacgctggacttcgagctgaccaagaccaccgcgaaggaggtcgccctcctgcgcacgtactgcatcgaggcctccatcagcaacatcaccaccgccacccggtgcccgacgcagggggagccctacctgaaggaggagcaggaccagcagtacatctgccgccgggacgtggtggaccgcggctgggggaacggctgcggcctcttcgggaagggcggggtcgtgacctgcgccaagttctcctgcagcggcaagatcaccgggaacctggtgcagatcgagaacctggagtacaccgtcgtggtgacggtccacaacggcgacacccacgcggtgggcaacgacacctccaaccacggggtgaccgccacgatcacgccccggagcccctccgtcgaggtgaagctcccggactacggcgagctgaccctggactgcgagccccgcagcgggatcgacttcaacgagatgatcctcatgaagatgaagaagaagacctggctggtgcacaagcagtggttcctggacctccccctgccctggaccgccggcgccgacacctccgaggtccactggaactacaaggagcggatggtgaccttcaaggtgccgcacgcgaagcgccaggacgtcaccgtgctggggagccaggagggcgccatgcactccgccctcgccggcgccacggaggtcgacagcggggacggcaaccacatgttcgcggggcacctgaagtgcaaggtgcggatggagaagctgcgcatcaagggcatgtcctacaccatgtgcagcgggaagttctccatcgacaaggagatggccgagacccagcacggcaccacggtggtcaaggtgaagtacgagggcgccggggccccctgcaaggtgcccatcgagatccgggacgtcaacaaggagaaggtggtgggccgcgtcatcagctccacgcccctcgccgagaacaccaacagcgtgaccaacatcgagctggagccgcccttcggggactcctacatcgtgatcggcgtcgggaacagcgcgctgaccctccactggttccggaagggcagctccatcggcaagatgttcgagagcacctaccgcggggccaagcggatggccatcctgggcgagaccgcctgggactga

SEQ ID NO: 1495 - RNA, 2031 nt, synthetic construct
  misc_feature 1..2031: note = derived and/or modified CDS sequence (opt1) from DENV-4 Consensus__SSc-prME
  source 1..2031: mol_type = other RNA
atgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggcgagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacgcccctggcggagaacaccaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctcgtgctgtggatcggcacgaactcccggaacaccagcatggccatgacctgcatcgccgtgggcgggatcaccctgttcctgggcttcacggtccaggcctga

SEQ ID NO: 1496 - RNA, 2031 nt, synthetic construct
  misc_feature 1..2031: note = derived and/or modified CDS sequence (opt1) from DENV-4 Consensus__SSc-prME(F108S)
  source 1..2031: mol_type = other RNA
atgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggcgagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgtccgggaagggcggggtggtgacgtgcgccaagttcagctgctccggcaagatcaccgggaacctggtccagatcgagaacctcgagtacaccgtggtggtcaccgtgcacaacggcgacacgcacgccgtcggcaacgacaccagcaaccacggggtgaccgccaccatcacgccccgctcccccagcgtggaggtcaagctgccggactacggcgagctgaccctcgactgcgagccccggtccgggatcgacttcaacgagatgatcctgatgaagatgaagaagaagacctggctggtgcacaagcagtggttcctcgacctgcccctgccctggaccgccggcgcggacaccagcgaggtgcactggaactacaaggagcgcatggtcacgttcaaggtgccgcacgccaagcggcaggacgtgaccgtcctcgggagccaggagggcgccatgcactccgccctggccggcgcgaccgaggtggacagcggggacggcaaccacatgttcgccgggcacctgaagtgcaaggtgcgcatggagaagctccgcatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatcagctccacgcccctggcggagaacaccaacagcgtgaccaacatcgagctggagccgcccttcggggactcctacatcgtcatcggcgtgggcaacagcgccctcaccctgcactggttccggaaggggtccagcatcggcaagatgttcgagtccacctaccgcggggccaagcggatggccatcctgggcgagacggcgtgggacttcgggagcgtgggcggcctcttcacctccctggggaaggccgtccaccaggtgttcggcagcgtgtacaccaccatgttcgggggcgtctcctggatgatccgcatcctgatcgggttcctcgtgctgtggatcggcacgaacagccggaacacctccatggccatgacctgcatcgccgtgggcgggatcaccctgttcctgggcttcacggtccaggcctga

SEQ ID NO: 1497 - RNA, 2031 nt, synthetic construct
  misc_feature 1..2031: note = derived and/or modified CDS sequence (opt1) from DENV-4 Consensus__SSc-prMEdelstem_TM-JEV
  source 1..2031: mol_type = other RNA
atgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggcgagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacgcccctggcggagaacaccaactccgtgaccaacatcgagctggagccgcccttcggggacagctacatcgtcatcggcgtgggcaactccgccctcaccctgcactggttccggaaggggagcaccctgggcaaggccttctccacgaccctcaagggggcccagcgcctggcggccctgggcgacaccgcctgggacttcgggagcatcggcggcgtgttcaactccatcgggcgggccgtccaccaggtgttcggcggggccttccgcaccctcttcggcgggatgagctggatcacgcagggcctgatgggcgcgctgctgctctggatgggggtgaacgcccgggaccgctccatcgccctggccttcctggccaccggcggggtcctcgtgttcctggcgaccaacgtgcacgcctga

SEQ ID NO: 1498 - RNA, 1332 nt, synthetic construct
  misc_feature 1..1332: note = derived and/or modified CDS sequence (opt1) from DENV-4 Consensus__SSm-EdelTM
  source 1..1332: mol_type = other RNA
atgatccagcgcaccgtgttcttcgtcctgatgatgctcgtggcccccagctacggcatgcggtgcgtgggggtcggcaaccgcgacttcgtggagggggtgtccggcggggcctgggtcgacctggtgctggagcacggcggctgcgtgaccacgatggcgcaggggaagcccaccctcgacttcgagctgaccaagaccacggccaaggaggtcgccctgctccggacctactgcatcgaggccagcatctccaacatcaccaccgccacgcgctgccccacccagggcgagccctacctgaaggaggagcaggaccagcagtacatctgccggcgcgacgtggtggaccgggggtggggcaacgggtgcggcctgttcggcaagggcggggtcgtgacctgcgcgaagttcagctgctccgggaagatcaccggcaacctcgtgcagatcgagaacctggagtacacggtcgtggtgaccgtccacaacggcgacacccacgccgtggggaacgacaccagcaaccacggcgtgacggccaccatcacgccccgctccccgagcgtcgaggtgaagctgcccgactacggggagctcaccctggactgcgagccccggtccggcatcgacttcaacgagatgatcctgatgaagatgaagaagaagacctggctcgtgcacaagcagtggttcctggacctgcccctcccgtggaccgccggggcggacaccagcgaggtccactggaactacaaggagcgcatggtgaccttcaaggtcccccacgccaagcggcaggacgtgacggtgctgggctcccaggagggcgccatgcacagcgccctggccggggcgaccgaggtcgactccggcgacgggaaccacatgttcgccggccacctcaagtgcaaggtgcgcatggagaagctgcggatcaaggggatgagctacaccatgtgctccggcaagttcagcatcgacaaggagatggccgagacccagcacggcacgaccgtggtcaaggtgaagtacgagggggccggcgccccctgcaaggtgcccatcgagatccgcgacgtcaacaaggagaaggtggtggggcgggtcatctccagcaccccgctggcggagaacaccaactccgtgacgaacatcgagctcgagccgcccttcggcgacagctacatcgtgatcggggtcggcaacagcgccctgaccctgcactggttccgcaagggctccagcatcgggaagatgttcgagtccacctaccggggcgccaagcgcatggccatcctcggggagaccgcctgggacttcggcagctga

SEQ ID NO: 1499 - RNA, 2376 nt, synthetic construct
  misc_feature 1..2376: note = derived and/or modified CDS sequence (opt1) from DENV-4 Consensus__C-P2A-SSc-prME
  source 1..2376: mol_type = other RNA
atgaaccagcgcaagaaggtggtccggcccccgttcaacatgctgaagcgcgagcggaaccgcgtgagcacgccccagggcctcgtgaagcggttctccaccgggctgttcagcggcaaggggcccctgcgcatggtcctcgccttcatcaccttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgcaacttcgacctgctcaagctggccggcgacgtggagagcaaccccgggccctccaccatcaccctgctctgcctgatccccacggtcatggccttccacctgagcacccgggacggcgagccgctcatgatcgtggccaagcacgagcgcgggcggcccctgctgttcaagaccaccgagggcatcaacaagtgcacgctcatcgccatggacctgggcgagatgtgcgaggacaccgtgacctacaagtgccccctgctcgtcaacaccgagcccgaggacatcgactgctggtgcaacctgacgtccacctgggtgatgtacgggacctgcacccagagcggcgagcgccggcgcgagaagcggtccgtggcgctgacgccgcacagcgggatgggcctcgagacccgcgccgagacctggatgtccagcgagggcgcctggaagcacgcccagcgggtcgagtcctggatcctgcgcaaccccgggttcgcgctgctcgccggcttcatggcctacatgatcgggcagaccggcatccagcgcacggtgttcttcgtgctgatgatgctggtcgcccccagctacgggatgcggtgcgtgggcgtgggcaaccgcgacttcgtcgagggggtgtccggcggggcctgggtggacctcgtcctggagcacggcgggtgcgtgaccaccatggcgcagggcaagcccaccctggacttcgagctcacgaagaccaccgccaaggaggtggccctgctgcggacctactgcatcgaggccagcatctccaacatcacgaccgccacccgctgcccgacccagggcgagccctacctcaaggaggagcaggaccagcagtacatctgccggcgcgacgtcgtggaccgggggtggggcaacgggtgcggcctgttcgggaagggcggcgtcgtgacgtgcgcgaagttcagctgctccgggaagatcaccggcaacctggtgcagatcgagaacctcgagtacaccgtcgtggtgaccgtccacaacggggacacgcacgccgtgggcaacgacaccagcaaccacggcgtgaccgccaccatcacgccccgcagcccctccgtcgaggtgaagctgccggactacggggagctgaccctcgactgcgagccccggagcggcatcgacttcaacgagatgatcctgatgaagatgaagaagaagacctggctggtgcacaagcagtggttcctcgacctgcccctgccctggaccgccggggccgacacctccgaggtccactggaactacaaggagcgcatggtgacgttcaaggtgccgcacgcgaagcggcaggacgtcaccgtgctgggcagccaggagggggccatgcactccgccctcgccggcgccaccgaggtggacagcggcgacgggaaccacatgttcgcgggccacctgaagtgcaaggtccgcatggagaagctgcggatcaaggggatgtcctacaccatgtgcagcggcaagttctccatcgacaaggagatggccgagacgcagcacgggaccaccgtggtgaaggtcaagtacgagggcgccggcgccccctgcaaggtgcccatcgagatccgcgacgtgaacaaggagaaggtcgtggggcgggtgatcagctccacgcccctcgcggagaacaccaacagcgtcaccaacatcgagctggagccgcccttcggcgactcctacatcgtgatcggggtgggcaacagcgccctgaccctccactggttccgcaaggggtccagcatcggcaagatgttcgagtccacctaccggggcgccaagcgcatggccatcctgggggagacggcctgggacttcggcagcgtcgggggcctgttcacctccctcgggaaggcggtgcaccaggtgttcggcagcgtctacaccaccatgttcggcggggtgagctggatgatccggatcctgatcggcttcctggtgctctggatcgggacgaactcccgcaacaccagcatggccatgacctgcatcgccgtcggcggcatcaccctgttcctggggttcacggtgcaggcctga

SEQ ID NO: 1500 - RNA, 2043 nt, synthetic construct
  misc_feature 1..2043: note = derived and/or modified CDS sequence (opt1) from DENV-4 Consensus__SSopt-prME(F108S)
  source 1..2043: mol_type = other RNA
atgaagcgcaagaagtccaccatcaccctgctctgcctgatccccacggtgatggccttccacctgagcacccgggacggcgagccgctcatgatcgtcgccaagcacgagcgcgggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggggagcgccggcgcgagaagcggagcgtggccctgacgccgcactccggcatgggcctcgagacccgcgccgagacctggatgagctccgagggggcctggaagcacgcccagcgggtggagagctggatcctgcgcaaccccggcttcgcgctgctcgccgggttcatggcctacatgatcggccagaccgggatccagcggacggtcttcttcgtgctgatgatgctggtggccccctcctacggcatgcgctgcgtcggcgtggggaaccgggacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcgcacctactgcatcgaggcctccatcagcaacatcacgaccgcgacccggtgcccgacccagggggagccctacctcaaggaggagcaggaccagcagtacatctgccgccgggacgtggtcgaccgcggctgggggaacggctgcggcctgtccgggaagggcggggtggtgacgtgcgccaagttcagctgctccggcaagatcaccgggaacctggtccagatcgagaacctcgagtacaccgtggtggtcaccgtgcacaacggcgacacgcacgccgtcggcaacgacaccagcaaccacggggtgaccgccaccatcacgccccggtcccccagcgtggaggtcaagctgccggactacggcgagctgaccctcgactgcgagccccgctccgggatcgacttcaacgagatgatcctgatgaagatgaagaagaagacctggctggtgcacaagcagtggttcctcgacctgcccctgccctggaccgccggcgcggacaccagcgaggtgcactggaactacaaggagcggatggtcacgttcaaggtgccgcacgccaagcgccaggacgtgaccgtcctcgggagccaggagggcgccatgcactccgccctggccggcgcgaccgaggtggacagcggggacggcaaccacatgttcgccgggcacctgaagtgcaaggtgcgcatggagaagctccggatcaagggcatgtcctacaccatgtgcagcggcaagttctccatcgacaaggagatggccgagacgcagcacgggaccaccgtcgtgaaggtgaagtacgagggcgccggggccccctgcaaggtccccatcgagatccgcgacgtgaacaaggagaaggtggtcggccgggtgatcagctccacgcccctggcggagaacaccaacagcgtgaccaacatcgagctggagccgcccttcggggactcctacatcgtcatcggcgtgggcaacagcgccctcaccctgcactggttccgcaaggggtccagcatcggcaagatgttcgagtccacctaccggggcgccaagcgcatggccatcctgggcgagacggcgtgggacttcgggagcgtgggcggcctcttcacctccctggggaaggccgtccaccaggtgttcggcagcgtgtacaccaccatgttcgggggcgtctcctggatgatccggatcctgatcgggttcctcgtgctgtggatcggcacgaacagccgcaacacctccatggccatgacctgcatcgccgtgggcgggatcaccctgttcctgggcttcacggtccaggcctga

SEQ ID NO: 1501 - RNA, 2043 nt, synthetic construct
  misc_feature 1..2043: note = derived and/or modified CDS sequence (opt1) from DENV-4 Consensus__SSopt-prME(V96H)
  source 1..2043: mol_type = other RNA
atgaagcgcaagaagtccaccatcaccctgctctgcctgatccccacggtgatggccttccacctgagcacccgggacggcgagccgctcatgatcgtcgccaagcacgagcgcgggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggggagcgccggcgcgagaagcggagcgtggccctgacgccgcactccggcatgggcctcgagacccgcgccgagacctggatgagctccgagggggcctggaagcacgcccagcgggtggagagctggatcctgcgcaaccccggcttcgcgctgctcgccgggttcatggcctacatgatcggccagaccgggatccagcggacggtcttcttcgtgctgatgatgctggtggccccctcctacggcatgcgctgcgtcggcgtggggaaccgggacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcgcacctactgcatcgaggcctccatcagcaacatcacgaccgcgacccggtgcccgacccagggggagccctacctcaaggaggagcaggaccagcagtacatctgccgccgggaccacgtggaccgcggctgggggaacggctgcggcctgttcgggaagggcggggtcgtgacgtgcgccaagttctcctgcagcggcaagatcaccgggaacctggtgcagatcgagaacctcgagtacaccgtcgtggtgaccgtccacaacggcgacacgcacgccgtgggcaacgacacctccaaccacggggtcaccgccaccatcacgccccggagcccctccgtggaggtgaagctgccggactacggcgagctgaccctcgactgcgagccccgcagcgggatcgacttcaacgagatgatcctgatgaagatgaagaagaagacctggctggtccacaagcagtggttcctcgacctgcccctgccctggaccgccggcgcggacacctccgaggtgcactggaactacaaggagcggatggtgacgttcaaggtcccgcacgccaagcgccaggacgtgaccgtgctcgggagccaggagggcgccatgcacagcgccctggccggcgcgaccgaggtcgactccggggacggcaaccacatgttcgccgggcacctgaagtgcaaggtgcgcatggagaagctccggatcaagggcatgagctacaccatgtgctccggcaagttcagcatcgacaaggagatggccgagacgcagcacgggaccaccgtggtcaaggtgaagtacgagggcgccggggccccctgcaaggtgcccatcgagatccgcgacgtcaacaaggagaaggtggtgggccgggtcatctccagcacgcccctggcggagaacaccaactccgtgaccaacatcgagctggagccgcccttcggggacagctacatcgtgatcggcgtcggcaactccgccctcaccctgcactggttccgcaaggggagctccatcggcaagatgttcgagagcacctaccggggcgccaagcgcatggccatcctgggcgagacggcgtgggacttcgggtccgtgggcggcctcttcaccagcctggggaaggccgtgcaccaggtcttcggctccgtgtacaccaccatgttcgggggcgtgagctggatgatccggatcctgatcgggttcctcgtcctgtggatcggcacgaactcccgcaacaccagcatggccatgacctgcatcgccgtgggcgggatcaccctgttcctgggcttcacggtgcaggcctga

SEQ ID NO: 1502 - RNA, 2043 nt, synthetic construct
  misc_feature 1..2043: note = derived and/or modified CDS sequence (opt1) from DENV-4 Consensus__SSopt-prME(E186F)
  source 1..2043: mol_type = other RNA
atgaagcgcaagaagtccaccatcaccctgctctgcctgatccccacggtgatggccttccacctgagcacccgggacggcgagccgctcatgatcgtcgccaagcacgagcgcgggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggggagcgccggcgcgagaagcggagcgtggccctgacgccgcactccggcatgggcctcgagacccgcgccgagacctggatgagctccgagggggcctggaagcacgcccagcgggtggagagctggatcctgcgcaaccccggcttcgcgctgctcgccgggttcatggcctacatgatcggccagaccgggatccagcggacggtcttcttcgtgctgatgatgctggtggccccctcctacggcatgcgctgcgtcggcgtggggaaccgggacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcgcacctactgcatcgaggcctccatcagcaacatcacgaccgcgacccggtgcccgacccagggggagccctacctcaaggaggagcaggaccagcagtacatctgccgccgggacgtggtcgaccgcggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccggagcccctccgtggaggtcaagctgccggactacggcgagctgaccctcgactgcttcccccgcagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcggatggtcacgttcaaggtgccgcacgccaagcgccaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccggatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgcgacgtgaacaaggagaaggtggtcggccgggtgatctccagcacgcccctggcggagaacaccaactccgtgaccaacatcgagctggagccgcccttcggggacagctacatcgtcatcggcgtgggcaactccgccctcaccctgcactggttccgcaaggggagctccatcggcaagatgttcgagagcacctaccggggcgccaagcgcatggccatcctgggcgagacggcgtgggacttcgggtccgtgggcggcctcttcaccagcctggggaaggccgtccaccaggtgttcggctccgtgtacaccaccatgttcgggggcgtcagctggatgatccggatcctgatcgggttcctcgtgctgtggatcggcacgaactcccgcaacaccagcatggccatgacctgcatcgccgtgggcgggatcaccctgttcctgggcttcacggtccaggcctga

SEQ ID NO: 1503 - RNA, 2043 nt, synthetic construct
  misc_feature 1..2043: note = derived and/or modified CDS sequence (opt1) from DENV-4 Consensus__SSopt-prME(R188L)
  source 1..2043: mol_type = other RNA
atgaagcgcaagaagtccaccatcaccctgctctgcctgatccccacggtgatggccttccacctgagcacccgggacggcgagccgctcatgatcgtcgccaagcacgagcgcgggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggcgagcgccggcgcgagaagcggagcgtggccctgacgccgcactccggcatgggcctcgagacccgcgccgagacctggatgagctccgagggggcctggaagcacgcccagcgggtggagagctggatcctgcgcaaccccggcttcgcgctgctcgccgggttcatggcctacatgatcggccagaccgggatccagcggacggtcttcttcgtgctgatgatgctggtggccccctcctacggcatgcgctgcgtcggcgtggggaaccgggacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcgcacctactgcatcgaggcctccatcagcaacatcacgaccgcgacccggtgcccgacccagggggagccctacctcaaggaggagcaggaccagcagtacatctgccgccgggacgtggtcgaccgcggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccggagcccctccgtggaggtcaagctgccggactacggcgagctgaccctcgactgcgagcccctgagcgggatcgacttcaacgagatgatcctgatgaagatgaagaagaagacctggctcgtgcacaagcagtggttcctggacctgcccctcccctggaccgccggcgcggacacctccgaggtgcactggaactacaaggagcgcatggtcacgttcaaggtgccgcacgccaagcggcaggacgtgaccgtcctggggagccaggagggcgccatgcacagcgccctggccggcgcgaccgaggtggactccggggacggcaaccacatgttcgccgggcacctcaagtgcaaggtgcgcatggagaagctgcgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcacgcccctggcggagaacaccaactccgtgaccaacatcgagctcgagccgcccttcggggacagctacatcgtcatcggcgtgggcaactccgccctgaccctgcactggttccggaaggggagctccatcggcaagatgttcgagagcacctaccgcggggccaagcggatggccatcctcggcgagacggcgtgggacttcgggtccgtgggcggcctgttcaccagcctggggaaggccgtccaccaggtgttcggctccgtgtacaccaccatgttcgggggcgtcagctggatgatccgcatcctcatcgggttcctggtgctgtggatcggcacgaactcccggaacaccagcatggccatgacctgcatcgccgtgggcgggatcaccctgttcctcggcttcacggtccaggcctga

SEQ ID NO: 1504 - RNA, 2043 nt, synthetic construct
  misc_feature 1..2043: note = derived and/or modified CDS sequence (opt1) from DENV-4 Consensus__SSopt-pr(D104A)MEdelstem_TM,(F108S)-JEV
  source 1..2043: mol_type = other RNA
atgaagcgcaagaagtccaccatcaccctgctctgcctgatccccacggtgatggccttccacctgagcacccgggacggcgagccgctcatgatcgtcgccaagcacgagcgcgggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggcgagcgccggcgcgccaagcggagcgtggccctgacgccgcactccggcatgggcctcgagacccgcgccgagacctggatgagctccgagggggcctggaagcacgcgcagcgggtggagagctggatcctgcgcaaccccggcttcgccctgctcgccgggttcatggcctacatgatcggccagaccgggatccagcggacggtcttcttcgtgctgatgatgctggtggcgccctcctacggcatgcgctgcgtcggcgtggggaaccgggacttcgtggagggcgtcagcgggggcgcctgggtggacctcgtgctggagcacggcgggtgcgtcaccaccatggcccagggcaagcccaccctggacttcgagctcacgaagaccaccgccaaggaggtggccctgctgcgcacctactgcatcgaggcgtccatcagcaacatcacgaccgccacccggtgcccgacccagggggagccctacctcaaggaggagcaggaccagcagtacatctgccgccgggacgtggtcgaccgcggctgggggaacggctgcggcctgtccgggaagggcggggtggtgacgtgcgccaagttcagctgctccggcaagatcaccgggaacctggtccagatcgagaacctcgagtacaccgtggtggtcaccgtgcacaacggcgacacgcacgccgtcggcaacgacaccagcaaccacggggtgaccgccaccatcacgccccggtcccccagcgtggaggtcaagctgccggactacggcgagctgaccctcgactgcgagccccgctccgggatcgacttcaacgagatgatcctgatgaagatgaagaagaagacctggctggtgcacaagcagtggttcctcgacctgcccctgccctggaccgcgggcgccgacaccagcgaggtgcactggaactacaaggagcggatggtcacgttcaaggtgccgcacgccaagcgccaggacgtgaccgtcctcgggagccaggagggcgccatgcactccgccctggcgggcgccaccgaggtggacagcggggacggcaaccacatgttcgccgggcacctgaagtgcaaggtgcgcatggagaagctccggatcaagggcatgtcctacaccatgtgcagcggcaagttctccatcgacaaggagatggccgagacgcagcacgggaccaccgtcgtgaaggtgaagtacgagggcgccggggcgccctgcaaggtccccatcgagatccgcgacgtgaacaaggagaaggtggtcggccgggtgatcagctccacgcccctggccgagaacaccaacagcgtgaccaacatcgagctggagccgcccttcggggactcctacatcgtcatcggcgtgggcaacagcgccctcaccctgcactggttccgcaaggggtccaccctgggcaaggccttcagcacgaccctcaagggggcgcagcggctggccgccctgggcgacaccgcctgggacttcgggtccatcggcggcgtgttcaacagcatcgggcgcgccgtccaccaggtgttcggcggggcgttccggaccctcttcggcgggatgtcctggatcacgcagggcctgatgggcgccctgctgctctggatgggggtgaacgcccgcgaccggagcatcgccctggccttcctggcgaccggcggggtcctcgtgttcctggccaccaacgtgcacgcctga

SEQ ID NO: 1505 - RNA, 2043 nt, synthetic construct
  misc_feature 1..2043: note = derived and/or modified CDS sequence (opt1) from DENV-4 Consensus__SSopt-prMEdelstem_TM,(H261N)-JEV
  source 1..2043: mol_type = other RNA
atgaagcgcaagaagtccaccatcaccctgctctgcctgatccccacggtgatggccttccacctgagcacccgggacggcgagccgctcatgatcgtcgccaagcacgagcgcgggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggcgagcgccggcgcgagaagcggagcgtggccctgacgccgcactccggcatgggcctcgagacccgcgccgagacctggatgagctccgagggggcctggaagcacgcccagcgggtggagagctggatcctgcgcaaccccggcttcgcgctgctcgccgggttcatggcctacatgatcggccagaccgggatccagcggacggtcttcttcgtgctgatgatgctggtggccccctcctacggcatgcgctgcgtcggcgtggggaaccgggacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcgcacctactgcatcgaggcctccatcagcaacatcacgaccgcgacccggtgcccgacccagggggagccctacctcaaggaggagcaggaccagcagtacatctgccgccgggacgtggtcgaccgcggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccggagcccctccgtggaggtcaagctgccggactacggcgagctgaccctcgactgcgagccccgcagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcggatggtcacgttcaaggtgccgcacgccaagcgccaggacgtgaccgtcctcgggagccaggagggcgccatgaacagcgccctggccggcgcgaccgaggtggactccggggacggcaaccacatgttcgccgggcacctgaagtgcaaggtgcgcatggagaagctccggatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgcgacgtgaacaaggagaaggtggtcggccgggtgatctccagcacgcccctggcggagaacaccaactccgtgaccaacatcgagctggagccgcccttcggggacagctacatcgtcatcggcgtgggcaactccgccctcaccctgcactggttccgcaaggggagcaccctgggcaaggccttctccacgaccctcaagggggcccagcggctggcggccctgggcgacaccgcctgggacttcgggagcatcggcggcgtgttcaactccatcgggcgcgccgtccaccaggtgttcggcggggccttccggaccctcttcggcgggatgagctggatcacgcagggcctgatgggcgcgctgctgctctggatgggggtgaacgcccgcgaccggtccatcgccctggccttcctggccaccggcggggtcctcgtgttcctggcgaccaacgtgcacgcctga

SEQ ID NO: 1506 - RNA, 2043 nt, synthetic construct
  misc_feature 1..2043: note = derived and/or modified CDS sequence (opt1) from DENV-4 Consensus__SSopt-prMEdelstem_TM,(R188L,A267T)-JEV
  source 1..2043: mol_type = other RNA
atgaagcgcaagaagtccaccatcaccctgctctgcctgatccccacggtgatggccttccacctgagcacccgggacggcgagccgctcatgatcgtcgccaagcacgagcgcgggcggcccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacgggacctgcacccagtccggcgagcgccggcgcgagaagcggagcgtggccctgacgccgcactccggcatgggcctcgagacccgcgccgagacctggatgagctccgagggggcctggaagcacgcccagcgggtggagagctggatcctgcgcaaccccggcttcgcgctgctcgccgggttcatggcctacatgatcggccagaccgggatccagcggacggtcttcttcgtgctgatgatgctggtggccccctcctacggcatgcgctgcgtcggcgtggggaaccgggacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcgcacctactgcatcgaggcctccatcagcaacatcacgaccgcgacccggtgcccgacccagggggagccctacctcaaggaggagcaggaccagcagtacatctgccgccgggacgtggtcgaccgcggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccggagcccctccgtggaggtcaagctgccggactacggcgagctgaccctcgactgcgagcccctgagcgggatcgacttcaacgagatgatcctgatgaagatgaagaagaagacctggctcgtgcacaagcagtggttcctggacctgcccctcccctggaccgccggcgcggacacctccgaggtgcactggaactacaaggagcgcatggtcacgttcaaggtgccgcacgccaagcggcaggacgtgaccgtcctggggagccaggagggcgccatgcacagcgccctggccggcaccaccgaggtggactccggggacggcaaccacatgttcgcggggcacctcaagtgcaaggtgcgcatggagaagctgcgcatcaagggcatgagctacacgatgtgctccggcaagttcagcatcgacaaggagatggccgagacccagcacgggaccaccgtcgtgaaggtgaagtacgagggcgccggggccccctgcaaggtccccatcgagatccgggacgtgaacaaggagaaggtggtcggccgcgtgatctccagcacgcccctggccgagaacaccaactccgtgaccaacatcgagctcgagccgcccttcggggacagctacatcgtcatcggcgtgggcaactccgcgctgaccctgcactggttccggaaggggagcacgctcggcaaggccttctccaccaccctgaagggggcccagcgcctggccgcgctcggcgacaccgcctgggacttcgggagcatcggcggcgtgttcaactccatcgggcgggccgtccaccaggtgttcggcggggccttccgcacgctgttcggcgggatgagctggatcacccagggcctgatgggcgccctgctcctgtggatgggggtgaacgcgcgggaccgctccatcgccctggccttcctcgccaccggcggggtcctggtgttcctggccaccaacgtgcacgcgtga

SEQ ID NO: 1507 - RNA, 300 nt, synthetic construct
  misc_feature 1..300: note = derived and/or modified CDS sequence (opt1) from DENV-3 Consensus__C
  source 1..300: mol_type = other RNA
atgaacaaccagcgcaagaagaccggcaagcccagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagtccggcgccatcaaggtcctgaaggggttcaagaaggagatcagcaacatgctgagcatcatcaacaagcggaagaag

SEQ ID NO: 1508 - RNA, 342 nt, synthetic construct
  misc_feature 1..342: note = derived and/or modified CDS sequence (opt1) from DENV-3 Consensus__C-SSc
  source 1..342: mol_type = other RNA
atgaacaaccagcgcaagaagaccggcaagcccagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagtccggcgccatcaaggtcctgaaggggttcaagaaggagatcagcaacatgctgagcatcatcaacaagcggaagaagacctccctctgcctgatgatgatcctgcccgcggccctcgcc

SEQ ID NO: 1509 - RNA, 273 nt, synthetic construct
  misc_feature 1..273: note = derived and/or modified CDS sequence (opt1) from DENV-3 Consensus__pr
  source 1..273: mol_type = other RNA
ttccacctgaccagccgcgacggcgagccccggatgatcgtggggaagaacgagcgcggcaagtccctcctgttcaagaccgccagcgggatcaacatgtgcacgctgatcgccatggacctcggcgagatgtgcgacgacaccgtcacctacaagtgcccgcacatcaccgaggtggagcccgaggacatcgactgctggtgcaacctgacgtccacctgggtgacctacgggacctgcaaccaggcgggcgagcaccggcgcgacaagcgg

SEQ ID NO: 1510 - RNA, 225 nt, synthetic construct
  misc_feature 1..225: note = derived and/or modified CDS sequence (opt1) from DENV-3 Consensus__M
  source 1..225: mol_type = other RNA
agcgtggccctggcgccccacgtcggcatggggctcgacacccgcacccagacgtggatgtccgccgagggcgcctggcgccaggtggagaaggtggagacctgggccctgcggcacccggggttcaccatcctggccctcttcctggcccactacatcggcaccagcctgacgcagaaggtcgtgatcttcatcctcctgatgctggtgaccccctccatgacc

SEQ ID NO: 1511 - RNA, 498 nt, synthetic construct
  misc_feature 1..498: note = derived and/or modified CDS sequence (opt1) from DENV-3 Consensus__prM
  source 1..498: mol_type = other RNA
ttccacctgaccagccgcgacggcgagccccggatgatcgtggggaagaacgagcgcggcaagtccctcctgttcaagaccgccagcgggatcaacatgtgcacgctgatcgccatggacctcggcgagatgtgcgacgacaccgtcacctacaagtgcccgcacatcaccgaggtggagcccgaggacatcgactgctggtgcaacctgacgtccacctgggtgacctacgggacctgcaaccaggcgggcgagcaccggcgcgacaagcggagcgtcgccctggcgccccacgtgggcatggggctcgacacgcgcacccagacctggatgtccgccgagggcgcctggcgccaggtggagaaggtcgagacctgggccctgcggcaccccgggttcacgatcctggccctcttcctggcccactacatcggcaccagcctgacccagaaggtggtgatcttcatcctcctgatgctggtcaccccgtccatgacg

SEQ ID NO: 1512 - RNA, 1479 nt, synthetic construct
  misc_feature 1..1479: note = derived and/or modified CDS sequence (opt1) from DENV-3 Consensus__E
  source 1..1479: mol_type = other RNA
atgcgctgcgtgggcgtcgggaaccgggacttcgtggagggcctgagcggggccacctgggtggacgtcgtgctcgagcacggcgggtgcgtgaccacgatggccaagaacaagcccaccctggacatcgagctgcagaagaccgaggcgacccagctcgccacgctgcgcaagctgtgcatcgagggcaagatcaccaacatcaccaccgactcccggtgccccacgcagggcgaggccaccctccccgaggagcaggaccagaactacgtctgcaagcacacctacgtggaccgcgggtggggcaacgggtgcggcctgttcgggaagggcagcctggtgacctgcgccaagttccagtgcctcgagcccatcgagggcaaggtcgtgcagtacgagaacctgaagtacacggtgatcatcaccgtccacaccggggaccagcaccaggtgggcaacgagacccagggggtgacggccgagatcacgccccaggcgtccaccaccgaggccatcctgccggagtacggcaccctcggcctggagtgcagcccccggaccgggctggacttcaacgagatgatcctcctgaccatgaagaacaaggcctggatggtccaccgccagtggttcttcgacctgcccctcccctggacctccggcgccacgaccgagaccccgacctggaaccggaaggagctgctggtgacgttcaagaacgcgcacgccaagaagcaggaggtggtcgtgctcgggagccaggagggcgccatgcacaccgccctgaccggggccaccgagatccagaactccggcggcacgagcatcttcgcggggcacctgaagtgccgcctcaagatggacaagctggagctgaagggcatgtcctacgccatgtgcaccaacaccttcgtgctcaagaaggaggtcagcgagacccagcacgggacgatcctgatcaaggtggagtacaagggcgaggacgtgccctgcaagatccccttctccaccgaggacgggcagggcaaggcccacaacggccggctgatcaccgccaaccccgtcgtgaccaagaaggaggagccggtcaacatcgaggccgagccgcccttcggggagagcaacatcgtgatcggcatcggggacaacgcgctcaagatcaactggtacaagaagggctccagcatcgggaagatgttcgaggccaccgcccgcggcgcccggcgcatggccatcctgggcgacacggcgtgggacttcgggtccgtgggcggggtcctgaacagcctcggcaagatggtgcaccagatcttcggctccgcctacaccgccctgttcagcggggtgtcctgggtcatgaagatcggcatcggggtgctgctcacctggatcggcctgaacagcaagaacaccagcatgtccttcagctgcatcgccatcgggatcatcacgctgtacctcggcgccgtggtccaggcg

SEQ ID NO: 1513 - RNA, 1977 nt, synthetic construct
  misc_feature 1..1977: note = derived and/or modified CDS sequence (opt1) from DENV-3 Consensus__prME
  source 1..1977: mol_type = other RNA
ttccacctgaccagccgcgacggcgagccccggatgatcgtggggaagaacgagcgcggcaagtccctcctgttcaagaccgccagcgggatcaacatgtgcacgctgatcgccatggacctcggcgagatgtgcgacgacaccgtcacctacaagtgcccgcacatcaccgaggtggagcccgaggacatcgactgctggtgcaacctgacgtccacctgggtgacctacgggacctgcaaccaggcgggcgagcaccggcgcgacaagcggagcgtcgccctggcgccccacgtgggcatggggctcgacacgcgcacccagacctggatgtccgccgagggcgcctggcgccaggtggagaaggtcgagacctgggccctgcggcaccccgggttcacgatcctggccctcttcctggcccactacatcggcaccagcctgacccagaaggtggtgatcttcatcctcctgatgctggtcaccccgtccatgacgatgcggtgcgtgggggtgggcaaccgcgacttcgtcgagggcctcagcggggccacctgggtggacgtggtcctggagcacggcgggtgcgtgaccaccatggcgaagaacaagcccacgctggacatcgagctccagaagaccgaggccacccagctggccaccctgcggaagctctgcatcgagggcaagatcacgaacatcaccaccgactcccgctgccccacccagggcgaggccacgctgcccgaggagcaggaccagaactacgtgtgcaagcacacctacgtcgaccgggggtggggcaacgggtgcggcctgttcgggaagggcagcctcgtgacctgcgccaagttccagtgcctggagccgatcgagggcaaggtggtccagtacgagaacctgaagtacaccgtgatcatcacggtgcacaccggggaccagcaccaggtcggcaacgagacccagggggtgaccgcggagatcacgccccaggcctccaccaccgaggccatcctccccgagtacggcaccctggggctggagtgcagcccccgcaccggcctcgacttcaacgagatgatcctgctgacgatgaagaacaaggcctggatggtccaccggcagtggttcttcgacctcccgctgccctggacctccggcgccaccaccgagacgcccacctggaaccgcaaggagctgctcgtgaccttcaagaacgcgcacgccaagaagcaggaggtggtcgtgctggggagccaggagggcgccatgcacaccgccctgacgggggccaccgagatccagaactccggcgggaccagcatcttcgcgggccacctcaagtgccggctgaagatggacaagctggagctcaagggcatgtcctacgccatgtgcaccaacacgttcgtgctgaagaaggaggtcagcgagacccagcacgggaccatcctgatcaaggtggagtacaagggcgaggacgtgccctgcaagatcccgttctccaccgaggacgggcagggcaaggcccacaacggccgcctcatcacggccaaccccgtcgtgaccaagaaggaggagcccgtgaacatcgaggccgagcccccgttcggggagagcaacatcgtcatcggcatcggggacaacgcgctgaagatcaactggtacaagaagggcagctccatcgggaagatgttcgaggccaccgcccggggcgcccgccggatggcgatcctgggcgacaccgcctgggacttcgggagcgtgggcggggtgctcaactccctgggcaagatggtccaccagatcttcgggagcgcctacacggccctgttctccggcgtgagctgggtgatgaagatcggcatcggggtcctgctcacctggatcggcctgaactccaagaacaccagcatgtccttcagctgcatcgccatcgggatcatcaccctgtacctcggcgcggtggtgcaggcc

SEQ ID NO: 1514 - RNA, 2019 nt, synthetic construct
  misc_feature 1..2019: note = derived and/or modified CDS sequence (opt1) from DENV-3 Consensus__SSc-prME
  source 1..2019: mol_type = other RNA
accagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcc

SEQ ID NO: 1515 - RNA, 1056 nt, synthetic construct
  misc_feature 1..1056: note = derived and/or modified CDS sequence (opt1) from DENV-3 Consensus__NS1
  source 1..1056: mol_type = other RNA
gacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtcaagagcctggtgtccgcg

SEQ ID NO: 1516 - RNA, 1857 nt, synthetic construct
  misc_feature 1..1857: note = derived and/or modified CDS sequence (opt1) from DENV-3 Consensus__NS3
  source 1..1857: mol_type = other RNA
agcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccccagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagtccgccgccatcgacggggagtaccgcctcaagggcgagagccggaagaccttcgtggagctgatgcgccgcggggacctgcccgtctggctcgcccacaaggtggccagcgagggcatcaagtacaccgaccggaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaag

SEQ ID NO: 1517 - RNA, 2319 nt, synthetic construct
  misc_feature 1..2319: note = derived and/or modified CDS sequence (opt1) from DENV-3 Consensus__C-prME
  source 1..2319: mol_type = other RNA
atgaacaaccagcgcaagaagaccggcaagcccagcatcaacatgctgaagcgggtgcgcaaccgggtctccaccgggagccagctcgccaagcgcttctccaagggcctgctgaacgggcagggcccgatgaagctcgtgatggccttcatcgcgttcctgcggttcctggccatcccgcccacggccggggtgctcgcccgctggggcaccttcaagaagtccggcgccatcaaggtcctgaaggggttcaagaaggagatcagcaacatgctgagcatcatcaacaagcggaagaagacctccctctgcctgatgatgatcctgcccgcggccctcgccttccacctgaccagccgcgacggcgagccccggatgatcgtggggaagaacgagcgcggcaagtccctcctgttcaagacggccagcgggatcaacatgtgcaccctgatcgcgatggacctgggcgagatgtgcgacgacaccgtgacctacaagtgcccccacatcacggaggtcgagcccgaggacatcgactgctggtgcaacctcacctccacctgggtgacctacggcacgtgcaaccaggccggggagcaccggcgcgacaagcggagcgtggccctggcgccccacgtcggcatggggctggacacccgcacccagacctggatgtccgccgagggcgcctggcggcaggtcgagaaggtggagacgtgggccctccgccacccgggcttcaccatcctggccctgttcctcgcccactacatcgggaccagcctgacccagaaggtcgtgatcttcatcctgctcatgctggtgacgccctccatgaccatgcggtgcgtcggcgtggggaaccgcgacttcgtggagggcctgagcggggccacctgggtcgacgtggtgctcgagcacggcggctgcgtcaccacgatggcgaagaacaagcccaccctggacatcgagctgcagaagaccgaggccacccagctcgccacgctgcggaagctgtgcatcgaggggaagatcaccaacatcaccaccgactcccgctgccccacgcagggcgaggccaccctcccggaggagcaggaccagaactacgtgtgcaagcacacctacgtggaccgggggtggggcaacgggtgcggcctgttcggcaaggggagcctggtgacctgcgccaagttccagtgcctcgagcccatcgagggcaaggtggtccagtacgagaacctgaagtacacggtgatcatcaccgtgcacaccggggaccagcaccaggtcggcaacgagacccagggggtgaccgcggagatcacgccccaggcctccaccaccgaggccatcctgcccgagtacggcaccctcggcctggagtgcagcccgcgcacggggctggacttcaacgagatgatcctcctgaccatgaagaacaaggcctggatggtgcaccgccagtggttcttcgacctgcccctcccctggaccagcggcgccaccacggagacccccacctggaaccggaaggagctgctggtcaccttcaagaacgcgcacgccaagaagcaggaggtggtggtcctggggtcccaggagggcgccatgcacacggccctcaccggcgcgaccgagatccagaacagcgggggcacctccatcttcgccgggcacctgaagtgccgcctgaagatggacaagctcgagctgaagggcatgagctacgccatgtgcacgaacaccttcgtgctgaagaaggaggtgtccgagacccagcacgggaccatcctcatcaaggtcgagtacaagggcgaggacgtgccgtgcaagatccccttcagcacggaggacggccaggggaaggcccacaacggccggctgatcaccgccaaccccgtggtcaccaagaaggaggagcccgtgaacatcgaggcggagccgcccttcggggagtccaacatcgtgatcggcatcggggacaacgccctgaagatcaactggtacaagaagggcagctccatcggcaagatgttcgaggccaccgcccgcggggcccggcgcatggcgatcctcggcgacacggcctgggacttcgggagcgtcggcggggtgctgaactccctgggcaagatggtgcaccagatcttcggcagcgcctacaccgccctcttctccggggtcagctgggtgatgaagatcggcatcggggtgctgctgacctggatcggcctcaactccaagaacaccagcatgtccttcagctgcatcgccatcgggatcatcacgctgtacctgggcgcggtcgtgcaggcc

SEQ ID NO: 1518 - RNA, 45 nt, synthetic construct; identical to SEQ ID NO: 1362
  misc_feature 1..45: note = derived and/or modified CDS sequence (opt1) from DENV-3 Consensus__SSc
  source 1..45: mol_type = other RNA

SEQ ID NO: 1519 - RNA, 57 nt, synthetic construct; identical to SEQ ID NO: 1363
  misc_feature 1..57: note = derived and/or modified CDS sequence (opt1) from DENV-3 Consensus__SSopt
  source 1..57: mol_type = other RNA

SEQ ID NO: 1520 - RNA, 57 nt, synthetic construct
  misc_feature 1..57: note = derived and/or modified CDS sequence (opt1) from DENV-3 Consensus__SSm
  source 1..57: mol_type = other RNA
atgacccagaaggtggtcatcttcatcctgctcatgctggtgacccccagcatgacg

SEQ ID NO: 1521 - RNA, 1482 nt, synthetic construct
  misc_feature 1..1482: note = derived and/or modified CDS sequence (opt1) from DENV-3 Consensus__E
  source 1..1482: mol_type = other RNA
atgcgctgcgtgggcgtcgggaaccgggacttcgtggagggcctgagcggggccacctgggtggacgtcgtgctcgagcacggcgggtgcgtgaccacgatggccaagaacaagcccaccctggacatcgagctgcagaagaccgaggcgacccagctcgccacgctgcgcaagctgtgcatcgagggcaagatcaccaacatcaccaccgactcccggtgccccacgcagggcgaggccaccctccccgaggagcaggaccagaactacgtctgcaagcacacctacgtggaccgcgggtggggcaacgggtgcggcctgttcgggaagggcagcctggtgacctgcgccaagttccagtgcctcgagcccatcgagggcaaggtcgtgcagtacgagaacctgaagtacacggtgatcatcaccgtccacaccggggaccagcaccaggtgggcaacgagacccagggggtgacggccgagatcacgccccaggcgtccaccaccgaggccatcctgccggagtacggcaccctcggcctggagtgcagcccccggaccgggctggacttcaacgagatgatcctcctgaccatgaagaacaaggcctggatggtccaccgccagtggttcttcgacctgcccctcccctggacctccggcgccacgaccgagaccccgacctggaaccggaaggagctgctggtgacgttcaagaacgcgcacgccaagaagcaggaggtggtcgtgctcgggagccaggagggcgccatgcacaccgccctgaccggggccaccgagatccagaactccggcggcacgagcatcttcgcggggcacctgaagtgccgcctcaagatggacaagctggagctgaagggcatgtcctacgccatgtgcaccaacaccttcgtgctcaagaaggaggtcagcgagacccagcacgggacgatcctgatcaaggtggagtacaagggcgaggacgtgccctgcaagatccccttctccaccgaggacgggcagggcaaggcccacaacggccggctgatcaccgccaaccccgtcgtgaccaagaaggaggagccggtcaacatcgaggccgagccgcccttcggggagagcaacatcgtgatcggcatcggggacaacgcgctcaagatcaactggtacaagaagggctccagcatcgggaagatgttcgaggccaccgcccgcggcgcccggcgcatggccatcctgggcgacacggcgtgggacttcgggtccgtgggcggggtcctgaacagcctcggcaagatggtgcaccagatcttcggctccgcctacaccgccctgttcagcggggtgtcctgggtcatgaagatcggcatcggggtgctgctcacctggatcggcctgaacagcaagaacaccagcatgtccttcagctgcatcgccatcgggatcatcacgctgtacctcggcgccgtggtccaggcgtga

SEQ ID NO: 1522 - RNA, 1176 nt, synthetic construct
  misc_feature 1..1176: note = derived and/or modified CDS sequence (opt1) from DENV-3 Consensus__EdelTM-variant (aa1-392)
  source 1..1176: mol_type = other RNA
atgcgctgcgtgggcgtcgggaaccgggacttcgtggagggcctgagcggggccacctgggtggacgtcgtgctcgagcacggcgggtgcgtgaccacgatggccaagaacaagcccaccctggacatcgagctgcagaagaccgaggcgacccagctcgccacgctgcgcaagctgtgcatcgagggcaagatcaccaacatcaccaccgactcccggtgccccacgcagggcgaggccaccctccccgaggagcaggaccagaactacgtctgcaagcacacctacgtggaccgcgggtggggcaacgggtgcggcctgttcgggaagggcagcctggtgacctgcgccaagttccagtgcctcgagcccatcgagggcaaggtcgtgcagtacgagaacctgaagtacacggtgatcatcaccgtccacaccggggaccagcaccaggtgggcaacgagacccagggggtgacggccgagatcacgccccaggcgtccaccaccgaggccatcctgccggagtacggcaccctcggcctggagtgcagcccccggaccgggctggacttcaacgagatgatcctcctgaccatgaagaacaaggcctggatggtccaccgccagtggttcttcgacctgcccctcccctggacctccggcgccacgaccgagaccccgacctggaaccggaaggagctgctggtgacgttcaagaacgcgcacgccaagaagcaggaggtggtcgtgctcgggagccaggagggcgccatgcacaccgccctgaccggggccaccgagatccagaactccggcggcacgagcatcttcgcggggcacctgaagtgccgcctcaagatggacaagctggagctgaagggcatgtcctacgccatgtgcaccaacaccttcgtgctcaagaaggaggtcagcgagacccagcacgggacgatcctgatcaaggtggagtacaagggcgaggacgtgccctgcaagatccccttctccaccgaggacgggcagggcaaggcccacaacggccggctgatcaccgccaaccccgtcgtgaccaagaaggaggagccggtcaacatcgaggccgagccgcccttcggggagagcaacatcgtgatcggcatcggggacaacgcgctcaagatcaactggtacaagaag

SEQ ID NO: 1523 - RNA, 1269 nt, synthetic construct
  misc_feature 1..1269: note = derived and/or modified CDS sequence (opt1) from DENV-3 Consensus__EdelTM-variant (aa1-422)
  source 1..1269: mol_type = other RNA
atgcgctgcgtgggcgtcgggaaccgggacttcgtggagggcctgagcggggccacctgggtggacgtcgtgctcgagcacggcgggtgcgtgaccacgatggccaagaacaagcccaccctggacatcgagctgcagaagaccgaggcgacccagctcgccacgctgcgcaagctgtgcatcgagggcaagatcaccaacatcaccaccgactcccggtgccccacgcagggcgaggccaccctccccgaggagcaggaccagaactacgtctgcaagcacacctacgtggaccgcgggtggggcaacgggtgcggcctgttcgggaagggcagcctggtgacctgcgccaagttccagtgcctcgagcccatcgagggcaaggtcgtgcagtacgagaacctgaagtacacggtgatcatcaccgtccacaccggggaccagcaccaggtgggcaacgagacccagggggtgacggccgagatcacgccccaggcgtccaccaccgaggccatcctgccggagtacggcaccctcggcctggagtgcagcccccggaccgggctggacttcaacgagatgatcctcctgaccatgaagaacaaggcctggatggtccaccgccagtggttcttcgacctgcccctcccctggacctccggcgccacgaccgagaccccgacctggaaccggaaggagctgctggtgacgttcaagaacgcgcacgccaagaagcaggaggtggtcgtgctcgggagccaggagggcgccatgcacaccgccctgaccggggccaccgagatccagaactccggcggcacgagcatcttcgcggggcacctgaagtgccgcctcaagatggacaagctggagctgaagggcatgtcctacgccatgtgcaccaacaccttcgtgctcaagaaggaggtcagcgagacccagcacgggacgatcctgatcaaggtggagtacaagggcgaggacgtgccctgcaagatccccttctccaccgaggacgggcagggcaaggcccacaacggccggctgatcaccgccaaccccgtcgtgaccaagaaggaggagccggtcaacatcgaggccgagccgcccttcggggagagcaacatcgtgatcggcatcggggacaacgcgctcaagatcaactggtacaagaagggctccagcatcgggaagatgttcgaggccaccgcccgcggcgcccggcgcatggccatcctgggcgacacggcgtgggacttcgggtcctga

SEQ ID NO: 1524 - RNA, 1260 nt, synthetic construct
  misc_feature 1..1260: note = derived and/or modified CDS sequence (opt1) from DENV-3 Consensus__EdelTM-variant (aa1-419)
  source 1..1260: mol_type = other RNA
atgcgctgcgtgggcgtcgggaaccgggacttcgtggagggcctgagcggggccacctgggtggacgtcgtgctcgagcacggcgggtgcgtgaccacgatggccaagaacaagcccaccctggacatcgagctgcagaagaccgaggcgacccagctcgccacgctgcgcaagctgtgcatcgagggcaagatcaccaacatcaccaccgactcccggtgccccacgcagggcgaggccaccctccccgaggagcaggaccagaactacgtctgcaagcacacctacgtggaccgcgggtggggcaacgggtgcggcctgttcgggaagggcagcctggtgacctgcgccaagttccagtgcctcgagcccatcgagggcaaggtcgtgcagtacgagaacctgaagtacacggtgatcatcaccgtccacaccggggaccagcaccaggtgggcaacgagacccagggggtgacggccgagatcacgccccaggcgtccaccaccgaggccatcctgccggagtacggcaccctcggcctggagtgcagcccccggaccgggctggacttcaacgagatgatcctcctgaccatgaagaacaaggcctggatggtccaccgccagtggttcttcgacctgcccctcccctggacctccggcgccacgaccgagaccccgacctggaaccggaaggagctgctggtgacgttcaagaacgcgcacgccaagaagcaggaggtggtcgtgctcgggagccaggagggcgccatgcacaccgccctgaccggggccaccgagatccagaactccggcggcacgagcatcttcgcggggcacctgaagtgccgcctcaagatggacaagctggagctgaagggcatgtcctacgccatgtgcaccaacaccttcgtgctcaagaaggaggtcagcgagacccagcacgggacgatcctgatcaaggtggagtacaagggcgaggacgtgccctgcaagatccccttctccaccgaggacgggcagggcaaggcccacaacggccggctgatcaccgccaaccccgtcgtgaccaagaaggaggagccggtcaacatcgaggccgagccgcccttcggggagagcaacatcgtgatcggcatcggggacaacgcgctcaagatcaactggtacaagaagggctccagcatcgggaagatgttcgaggccaccgcccgcggcgcccggcgcatggccatcctgggcgacacggcgtgggactga

SEQ ID NO: 1525 - RNA, 1155 nt, synthetic construct
  misc_feature 1..1155: note = derived and/or modified CDS sequence (opt1) from DENV-3 Consensus__Edelaa101-107
  source 1..1155: mol_type = other RNA
atgcgctgcgtgggcgtcgggaaccgggacttcgtggagggcctgagcggggccacctgggtggacgtcgtgctcgagcacggcgggtgcgtgaccacgatggccaagaacaagcccaccctggacatcgagctgcagaagaccgaggcgacccagctcgccacgctgcgcaagctgtgcatcgagggcaagatcaccaacatcaccaccgactcccggtgccccacgcagggcgaggccaccctccccgaggagcaggaccagaactacgtctgcaagcacacctacgtggaccgcgggttcggcaaggggagcctggtgacctgcgccaagttccagtgcctggagcccatcgagggcaaggtcgtgcagtacgagaacctcaagtacacggtgatcatcaccgtccacaccggggaccagcaccaggtgggcaacgagacccagggcgtgacggccgagatcacgccccaggcgtccaccaccgaggccatcctgccggagtacgggaccctgggcctcgagtgcagcccccggaccgggctggacttcaacgagatgatcctgctcaccatgaagaacaaggcctggatggtccaccgccagtggttcttcgacctgcccctgccctggacctccggcgccacgaccgagaccccgacctggaaccggaaggagctcctggtgacgttcaagaacgcgcacgccaagaagcaggaggtggtcgtgctgggcagccaggagggggccatgcacaccgccctcaccggcgccaccgagatccagaactccgggggcacgagcatcttcgcggggcacctgaagtgccgcctgaagatggacaagctcgagctgaagggcatgtcctacgccatgtgcaccaacaccttcgtgctgaagaaggaggtcagcgagacccagcacggcacgatcctcatcaaggtggagtacaagggggaggacgtgccctgcaagatccccttctccaccgaggacggccaggggaaggcccacaacggccggctgatcaccgccaaccccgtcgtgaccaagaaggaggagccggtcaacatcgaggccgagccgcccttcggggagagcaacatcgtgatcggcatcggcgacaacgcgctgaagatcaactggtacaagaag

SEQ ID NO: 1526 - RNA, 1173 nt, synthetic construct
  misc_feature 1..1173: note = derived and/or modified CDS sequence (opt1) from DENV-3 Consensus__EdelTM-variant (aa1-391)
  source 1..1173: mol_type = other RNA
atgcgctgcgtgggcgtcgggaaccgggacttcgtggagggcctgagcggggccacctgggtggacgtcgtgctcgagcacggcgggtgcgtgaccacgatggccaagaacaagcccaccctggacatcgagctgcagaagaccgaggcgacccagctcgccacgctgcgcaagctgtgcatcgagggcaagatcaccaacatcaccaccgactcccggtgccccacgcagggcgaggccaccctccccgaggagcaggaccagaactacgtctgcaagcacacctacgtggaccgcgggtggggcaacgggtgcggcctgttcgggaagggcagcctggtgacctgcgccaagttccagtgcctcgagcccatcgagggcaaggtcgtgcagtacgagaacctgaagtacacggtgatcatcaccgtccacaccggggaccagcaccaggtgggcaacgagacccagggggtgacggccgagatcacgccccaggcgtccaccaccgaggccatcctgccggagtacggcaccctcggcctggagtgcagcccccggaccgggctggacttcaacgagatgatcctcctgaccatgaagaacaaggcctggatggtccaccgccagtggttcttcgacctgcccctcccctggacctccggcgccacgaccgagaccccgacctggaaccggaaggagctgctggtgacgttcaagaacgcgcacgccaagaagcaggaggtggtcgtgctcgggagccaggagggcgccatgcacaccgccctgaccggggccaccgagatccagaactccggcggcacgagcatcttcgcggggcacctgaagtgccgcctcaagatggacaagctggagctgaagggcatgtcctacgccatgtgcaccaacaccttcgtgctcaagaaggaggtcagcgagacccagcacgggacgatcctgatcaaggtggagtacaagggcgaggacgtgccctgcaagatccccttctccaccgaggacgggcagggcaaggcccacaacggccggctgatcaccgccaaccccgtcgtgaccaagaaggaggagccggtcaacatcgaggccgagccgcccttcggggagagcaacatcgtgatcggcatcggggacaacgcgctcaagatcaactggtacaag

SEQ ID NO: 1527 - RNA, 2025 nt, synthetic construct
  misc_feature 1..2025: note = derived and/or modified CDS sequence (opt1) from DENV-3 Consensus__SSc-prME
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1528 - RNA, 2025 nt, synthetic construct
  misc_feature 1..2025: note = derived and/or modified CDS sequence (opt1) from DENV-3 Consensus__SSc-prME(F108S)
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctctccgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcctccaccaccgaggcgatcctgcccgagtacggcaccctggggctcgagtgcagcccgcgcaccggcctggacttcaacgagatgatcctgctcaccatgaagaacaaggcctggatggtccaccggcagtggttcttcgacctgcccctgccctggacctccggcgccaccacggagacccccacctggaaccgcaaggagctcctggtgaccttcaagaacgcccacgccaagaagcaggaggtggtcgtgctggggagccaggagggcgcgatgcacacggccctcaccggggccaccgagatccagaactccggcgggaccagcatcttcgccggccacctgaagtgccggctgaagatggacaagctcgagctgaagggcatgtcctacgccatgtgcacgaacaccttcgtgctgaagaaggaggtcagcgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagtccaacatcgtcatcggcatcggggacaacgccctgaagatcaactggtacaagaagggcagctccatcgggaagatgttcgaggcgaccgcccggggcgcccgccggatggccatcctgggcgacacggcctgggacttcgggagcgtgggcggggtgctcaactccctgggcaagatggtccaccagatcttcgggagcgcgtacaccgccctgttctccggcgtgagctgggtgatgaagatcggcatcggggtcctcctgacctggatcggcctgaactccaagaacaccagcatgtccttcagctgcatcgccatcgggatcatcacgctctacctgggcgccgtggtgcaggcctga

SEQ ID NO: 1529 - RNA, 2025 nt, synthetic construct
  misc_feature 1..2025: note = derived and/or modified CDS sequence (opt1) from DENV-3 Consensus__SSc-prME(R186L)
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgctgaccggcctggacttcaacgagatgatcctcctgaccatgaagaacaaggcctggatggtccaccgccagtggttcttcgacctgcccctcccctggaccagcggcgccaccacggagacccccacctggaaccggaaggagctgctggtgaccttcaagaacgcccacgccaagaagcaggaggtggtcgtgctcgggtcccaggagggcgcgatgcacacggccctgaccggggccaccgagatccagaacagcggcgggacctccatcttcgccggccacctgaagtgccgcctcaagatggacaagctggagctgaagggcatgagctacgccatgtgcacgaacaccttcgtgctcaagaaggaggtctccgagacccagcacgggaccatcctgatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctcggcgacacggcctgggacttcgggtccgtgggcggggtgctgaacagcctgggcaagatggtccaccagatcttcgggtccgcgtacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcctga

SEQ ID NO: 1530 - RNA, 2025 nt, synthetic construct
  misc_feature 1..2025: note = derived and/or modified CDS sequence (opt1) from DENV-3 Consensus__SSc-prME(A265T)
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacgtccatcttcgccggccacctgaagtgccggctgaagatggacaagctcgagctgaagggcatgagctacgccatgtgcaccaacaccttcgtgctgaagaaggaggtctccgagacccagcacgggacgatcctcatcaaggtggagtacaagggcgaggacgtgccgtgcaagatccccttcagcaccgaggacgggcagggcaaggcccacaacggccgcctgatcaccgcgaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggccacggcgcggggcgcccgccggatggccatcctgggcgacaccgcctgggacttcgggtccgtgggcggggtgctcaacagcctgggcaagatggtccaccagatcttcgggtccgcctacaccgcgctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggcctga

SEQ ID NO: 1531 - RNA, 2025 nt, synthetic construct
  misc_feature 1..2025: note = derived and/or modified CDS sequence (opt1) from DENV-3 Consensus__SSc-prMEdelstem_TM-JEV
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccaccctggggaaggcgttcagcacgaccctcaagggcgcccagcggctggccgccctgggcgacaccgcctgggacttcgggtccatcggcggggtgttcaacagcatcggccgcgcggtgcaccaggtcttcgggggcgccttccggaccctcttcggcgggatgtcctggatcacgcagggcctgatgggggccctgctcctgtggatgggcgtgaacgcccgcgaccgcagcatcgccctggcgttcctcgccaccgggggcgtgctggtcttcctggccaccaacgtgcacgcctga

SEQ ID NO: 1532 - RNA, 1326 nt, synthetic construct
  misc_feature 1..1326: note = derived and/or modified CDS sequence (opt1) from DENV-3 Consensus__SSm-EdelTM
  source 1..1326: mol_type = other RNA
atgacccagaaggtggtcatcttcatcctgctcatgctggtgacccccagcatgacgatgcgctgcgtgggcgtcgggaaccgggacttcgtggagggcctgtccggggccacctgggtggacgtcgtgctcgagcacggcgggtgcgtgaccaccatggccaagaacaagcccacgctggacatcgagctgcagaagaccgaggcgacccagctcgccaccctgcgcaagctgtgcatcgagggcaagatcacgaacatcaccaccgacagccggtgccccacccagggcgaggccacgctccccgaggagcaggaccagaactacgtctgcaagcacacctacgtggaccgcgggtggggcaacgggtgcggcctgttcgggaagggctccctggtgacctgcgccaagttccagtgcctcgagcccatcgagggcaaggtcgtgcagtacgagaacctgaagtacaccgtgatcatcacggtccacaccggggaccagcaccaggtgggcaacgagacccagggggtgaccgccgagatcacgccgcaggcgagcaccaccgaggccatcctgcccgagtacggcaccctcggcctggagtgcagcccccggacggggctggacttcaacgagatgatcctcctgaccatgaagaacaaggcctggatggtccaccgccagtggttcttcgacctgcccctcccgtggacctccggcgccaccacggagacccccacctggaaccggaaggagctgctggtgaccttcaagaacgcgcacgccaagaagcaggaggtggtcgtgctcgggtcccaggagggcgccatgcacacggccctgaccggggccaccgagatccagaacagcggcggcacctccatcttcgcggggcacctgaagtgccgcctcaagatggacaagctggagctgaagggcatgagctacgccatgtgcacgaacaccttcgtgctcaagaaggaggtctccgagacccagcacgggaccatcctgatcaaggtggagtacaagggcgaggacgtcccctgcaagatccccttcagcaccgaggacgggcagggcaaggcccacaacggccggctgatcacggccaacccggtggtgaccaagaaggaggagcccgtcaacatcgaggccgagccgcccttcggggagtccaacatcgtgatcggcatcggggacaacgcgctcaagatcaactggtacaagaagggcagctccatcgggaagatgttcgaggccaccgcccgcggcgcccggcgcatggccatcctgggcgacaccgcgtgggacttcgggagctga

SEQ ID NO: 1533 - RNA, 2373 nt, synthetic construct
  misc_feature 1..2373: note = derived and/or modified CDS sequence (opt1) from DENV-3 Consensus__C-P2A-SSc-prME
  source 1..2373: mol_type = other RNA
atgaacaaccagcgcaagaagaccggcaagcccagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagtccggcgccatcaaggtcctgaaggggttcaagaaggagatcagcaacatgctgagcatcatcaacaagcggaagaagaacttcgacctcctgaagctggcgggcgacgtggagtccaaccccgggcccaccagcctctgcctgatgatgatcctgcccgccgccctcgccttccacctgacctcccgcgacggcgagccccggatgatcgtggggaagaacgagcgcggcaagagcctcctgttcaagacggcgtccggcatcaacatgtgcaccctgatcgccatggacctgggggagatgtgcgacgacaccgtcacctacaagtgcccccacatcacggaggtggagccggaggacatcgactgctggtgcaacctcaccagcacctgggtgacctacggcacgtgcaaccaggccggggagcaccggcgcgacaagcggtccgtcgccctggcgccccacgtgggcatgggcctggacacccgcacccagacctggatgagcgccgagggggcctggcgccaggtggagaaggtcgagacgtgggccctccggcaccccggcttcaccatcctggccctgttcctcgcccactacatcgggacctccctgacccagaaggtggtgatcttcatcctgctcatgctggtcacgcccagcatgaccatgcggtgcgtgggcgtggggaaccgcgacttcgtcgagggcctgtccggcgcgacctgggtggacgtggtcctcgagcacgggggctgcgtgaccacgatggccaagaacaagccgaccctggacatcgagctgcagaagaccgaggccacccagctcgccacgctgcggaagctgtgcatcgaggggaagatcaccaacatcaccaccgacagccgctgccccacgcagggcgaggccaccctccccgaggagcaggaccagaactacgtgtgcaagcacacctacgtcgaccgggggtggggcaacggctgcgggctgttcggcaaggggtccctggtgacctgcgcgaagttccagtgcctcgagcccatcgagggcaaggtcgtgcagtacgagaacctgaagtacacggtgatcatcaccgtccacaccggggaccagcaccaggtgggcaacgagacccagggcgtgaccgccgagatcacgccgcaggccagcaccaccgaggccatcctgcccgagtacgggaccctcggcctggagtgcagcccccgcacggggctggacttcaacgagatgatcctcctgaccatgaagaacaaggcctggatggtccaccgccagtggttcttcgacctgcccctgccgtggacctccggcgcgaccacggagacccccacctggaaccggaaggagctcctggtgaccttcaagaacgcccacgccaagaagcaggaggtggtcgtgctgggcagccaggagggggccatgcacacggcgctcaccggcgccaccgagatccagaactccgggggcaccagcatcttcgccgggcacctgaagtgccgcctgaagatggacaagctcgagctgaagggcatgtcctacgccatgtgcacgaacaccttcgtgctgaagaaggaggtcagcgagacccagcacggcaccatcctcatcaaggtggagtacaagggggaggacgtgccctgcaagatccccttctccacggaggacggccaggggaaggcccacaacggccggctgatcaccgcgaacccggtcgtgaccaagaaggaggagcccgtgaacatcgaggccgagccgcccttcggggagagcaacatcgtcatcggcatcggcgacaacgccctgaagatcaactggtacaagaaggggtccagcatcggcaagatgttcgaggccaccgcccgcggggcgcggcgcatggccatcctcggcgacacggcctgggacttcgggtccgtgggcggcgtgctgaacagcctggggaagatggtccaccagatcttcggctccgcctacaccgccctcttcagcggggtgtcctgggtgatgaagatcggcatcggggtcctgctgacctggatcggcctcaacagcaagaacacctccatgagcttctcctgcatcgcgatcggcatcatcacgctgtacctgggggccgtggtgcaggcctga

SEQ ID NO: 1534 - RNA, 2037 nt, synthetic construct
  misc_feature 1..2037: note = derived and/or modified CDS sequence (opt1) from DENV-3 Consensus__SSopt-prME
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1535 - RNA, 2037 nt, synthetic construct
  misc_feature 1..2037: note = derived and/or modified CDS sequence (opt1) from DENV-3 Consensus__SSopt-prME(F108S)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctctccgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcctccaccaccgaggcgatcctgcccgagtacggcaccctggggctcgagtgcagcccgcggaccggcctggacttcaacgagatgatcctgctcaccatgaagaacaaggcctggatggtccaccgccagtggttcttcgacctgcccctgccctggacctccggcgccaccacggagacccccacctggaaccggaaggagctcctggtgaccttcaagaacgcccacgccaagaagcaggaggtggtcgtgctggggagccaggagggcgcgatgcacacggccctcaccggggccaccgagatccagaactccggcgggaccagcatcttcgccggccacctgaagtgccgcctgaagatggacaagctcgagctgaagggcatgtcctacgccatgtgcacgaacaccttcgtgctgaagaaggaggtcagcgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagtccaacatcgtcatcggcatcggggacaacgccctgaagatcaactggtacaagaagggcagctccatcgggaagatgttcgaggcgaccgcccgcggcgcccggcgcatggccatcctgggcgacacggcctgggacttcgggagcgtgggcggggtgctcaactccctgggcaagatggtccaccagatcttcgggagcgcgtacaccgccctgttctccggcgtgagctgggtgatgaagatcggcatcggggtcctcctgacctggatcggcctgaactccaagaacaccagcatgtccttcagctgcatcgccatcgggatcatcacgctctacctgggcgccgtggtgcaggcctga

SEQ ID NO: 1536 - RNA, 2037 nt, synthetic construct
  misc_feature 1..2037: note = derived and/or modified CDS sequence (opt1) from DENV-3 Consensus__SSopt-prME(H27N)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagaacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1537 - RNA, 2037 nt, synthetic construct
  misc_feature 1..2037: note = derived and/or modified CDS sequence (opt1) from DENV-3 Consensus__SSopt-prME(T76I)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccatccagggcgaggccacgctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacaccgtgatcatcacggtgcacaccggggaccagcaccaggtcggcaacgagacccagggggtgaccgccgagatcacgccccaggccagcaccaccgaggcgatcctgcccgagtacggcaccctggggctcgagtgctccccgcggaccggcctggacttcaacgagatgatcctgctcacgatgaagaacaaggcctggatggtccaccgccagtggttcttcgacctgcccctgccctggaccagcggcgccaccaccgagacgcccacctggaaccggaaggagctcctggtgaccttcaagaacgcccacgccaagaagcaggaggtggtcgtgctggggtcccaggagggcgcgatgcacaccgccctcacgggggccaccgagatccagaacagcggcgggacctccatcttcgccggccacctgaagtgccgcctgaagatggacaagctcgagctgaagggcatgagctacgccatgtgcaccaacacgttcgtgctgaagaaggaggtctccgagacccagcacgggaccatcctcatcaaggtggagtacaagggcgaggacgtgccgtgcaagatccccttcagcaccgaggacgggcagggcaaggcgcacaacggccggctgatcacggccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacaccgcctgggacttcgggtccgtgggcggggtgctcaacagcctgggcaagatggtccaccagatcttcgggtccgcgtacacggccctgttcagcggcgtgtcctgggtgatgaagatcggcatcggggtcctcctgacctggatcggcctgaacagcaagaacacctccatgagcttctcctgcatcgccatcgggatcatcaccctctacctgggcgccgtggtgcaggcctga

SEQ ID NO: 1538 - RNA, 2037 nt, synthetic construct
  misc_feature 1..2037: note = derived and/or modified CDS sequence (opt1) from DENV-3 Consensus__SSopt-prME(N89D)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccaggactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1539 - RNA, 2037 nt, synthetic construct
  misc_feature 1..2037: note = derived and/or modified CDS sequence (opt1) from DENV-3 Consensus__SSopt-prME(Y96H)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacccacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1540 - RNA, 2037 nt, synthetic construct
  misc_feature 1..2037: note = derived and/or modified CDS sequence (opt1) from DENV-3 Consensus__SSopt-prME(K110E)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcggggagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1541 - RNA, 2037 nt, synthetic construct
  misc_feature 1..2037: note = derived and/or modified CDS sequence (opt1) from DENV-3 Consensus__SSopt-prME(H149N)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagaaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1542 - RNA, 2037 nt, synthetic construct
  misc_feature 1..2037: note = derived and/or modified CDS sequence (opt1) from DENV-3 Consensus__SSopt-prME(S184F)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgcttcccgcggaccggcctggacttcaacgagatgatcctgctcaccatgaagaacaaggcctggatggtccaccgccagtggttcttcgacctgcccctgccctggacctccggcgccaccacggagacccccacctggaaccggaaggagctcctggtgaccttcaagaacgcccacgccaagaagcaggaggtggtcgtgctggggagccaggagggcgcgatgcacacggccctcaccggggccaccgagatccagaactccggcgggaccagcatcttcgccggccacctgaagtgccgcctgaagatggacaagctcgagctgaagggcatgtcctacgccatgtgcacgaacaccttcgtgctgaagaaggaggtcagcgagacccagcacgggaccatcctcatcaaggtggagtacaagggcgaggacgtgccgtgcaagatccccttctccacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagctccatcgggaagatgttcgaggcgaccgcccgcggcgcccggcgcatggccatcctgggcgacacggcctgggacttcgggagcgtgggcggggtgctcaactccctgggcaagatggtccaccagatcttcgggagcgcgtacaccgccctgttctccggcgtgagctgggtgatgaagatcggcatcggggtcctcctgacctggatcggcctgaactccaagaacaccagcatgtccttcagctgcatcgccatcgggatcatcacgctctacctgggcgccgtggtgcaggcctga

SEQ ID NO: 1543 - RNA, 2037 nt, synthetic construct
  misc_feature 1..2037: note = derived and/or modified CDS sequence (opt1) from DENV-3 Consensus__SSopt-prME(R186L)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgctgaccggcctggacttcaacgagatgatcctcctgaccatgaagaacaaggcctggatggtccaccggcagtggttcttcgacctgcccctcccctggaccagcggcgccaccacggagacccccacctggaaccgcaaggagctgctggtgaccttcaagaacgcccacgccaagaagcaggaggtggtcgtgctcgggtcccaggagggcgcgatgcacacggccctgaccggggccaccgagatccagaacagcggcgggacctccatcttcgccggccacctgaagtgccggctcaagatggacaagctggagctgaagggcatgagctacgccatgtgcacgaacaccttcgtgctcaagaaggaggtctccgagacccagcacgggaccatcctgatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctcggcgacacggcctgggacttcgggtccgtgggcggggtgctgaacagcctgggcaagatggtccaccagatcttcgggtccgcgtacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcctga

SEQ ID NO: 1544 - RNA, 2037 nt, synthetic construct
  misc_feature 1..2037: note = derived and/or modified CDS sequence (opt1) from DENV-3 Consensus__SSopt-prME(N240S)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagtccgcccacgccaagaagcaggaggtggtcgtgctggggagccaggagggcgcgatgcacacggccctcaccggggccaccgagatccagaactccggcgggaccagcatcttcgccggccacctgaagtgccgcctgaagatggacaagctcgagctgaagggcatgtcctacgccatgtgcacgaacaccttcgtgctgaagaaggaggtcagcgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagtccaacatcgtcatcggcatcggggacaacgccctgaagatcaactggtacaagaagggcagctccatcgggaagatgttcgaggcgaccgcccgcggcgcccggcgcatggccatcctgggcgacacggcctgggacttcgggagcgtgggcggggtgctcaactccctgggcaagatggtccaccagatcttcgggagcgcgtacaccgccctgttctccggcgtgagctgggtgatgaagatcggcatcggggtcctcctgacctggatcggcctgaactccaagaacaccagcatgtccttcagctgcatcgccatcgggatcatcacgctctacctgggcgccgtggtgcaggcctga

SEQ ID NO: 1545 - RNA, 2037 nt, synthetic construct
  misc_feature 1..2037: note = derived and/or modified CDS sequence (opt1) from DENV-3 Consensus__SSopt-prME(M258L)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgctccacacggccctgaccggggccaccgagatccagaacagcggcgggacctccatcttcgccggccacctgaagtgccgcctcaagatggacaagctggagctgaagggcatgagctacgccatgtgcacgaacaccttcgtgctcaagaaggaggtctccgagacccagcacgggaccatcctgatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctcggcgacacggcctgggacttcgggtccgtgggcggggtgctgaacagcctgggcaagatggtccaccagatcttcgggtccgcgtacaccgccctcttcagcggcgtgtcctgggtgatgaagatcggcatcggggtcctgctgacctggatcggcctcaacagcaagaacacctccatgagcttctcctgcatcgccatcgggatcatcacgctgtacctgggcgccgtggtgcaggcctga

SEQ ID NO: 1546 - RNA, 2037 nt, synthetic construct
  misc_feature 1..2037: note = derived and/or modified CDS sequence (opt1) from DENV-3 Consensus__SSopt-prME(H259N)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgaacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccgcggcgcccggcgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1547 - RNA, 2037 nt, synthetic construct
  misc_feature 1..2037: note = derived and/or modified CDS sequence (opt1) from DENV-3 Consensus__SSopt-prME(H259R)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcgcacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccgcatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1548 - RNA, 2037 nt, synthetic construct
  misc_feature 1..2037: note = derived and/or modified CDS sequence (opt1) from DENV-3 Consensus__SSopt-prME(A265T)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccgggaccaccgagatccagaacagcggcgggacgtccatcttcgccggccacctgaagtgccgcctgaagatggacaagctcgagctgaagggcatgagctacgccatgtgcaccaacaccttcgtgctgaagaaggaggtctccgagacccagcacgggacgatcctcatcaaggtggagtacaagggcgaggacgtgccgtgcaagatccccttcagcaccgaggacgggcagggcaaggcccacaacggccggctgatcaccgcgaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggccacggcgcgcggcgcccggcgcatggccatcctgggcgacaccgcctgggacttcgggtccgtgggcggggtgctcaacagcctgggcaagatggtccaccagatcttcgggtccgcctacaccgcgctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggcctga

SEQ ID NO: 1549 - RNA, 2037 nt, synthetic construct
  misc_feature 1..2037: note = derived and/or modified CDS sequence (opt1) from DENV-3 Consensus__SSopt-prME(S296G)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatggggtacgccatgtgcacgaacaccttcgtgctgaagaaggaggtcagcgagacccagcacggcaccatcctcatcaaggtggagtacaagggggaggacgtgccgtgcaagatccccttctccacggaggacggccagggcaaggcgcacaacgggcggctgatcaccgccaaccccgtcgtgaccaagaaggaggagcccgtgaacatcgaggccgagccgcccttcggcgagagcaacatcgtcatcgggatcggcgacaacgccctgaagatcaactggtacaagaaggggagctccatcggcaagatgttcgaggcgaccgcccgcggcgcccggcgcatggccatcctgggggacacggcctgggacttcggcagcgtcgggggcgtgctcaactccctggggaagatggtgcaccagatcttcggcagcgcgtacaccgccctgttctccggcgtgagctgggtgatgaagatcgggatcggcgtcctcctgacctggatcgggctgaactccaagaacaccagcatgtccttcagctgcatcgccatcggcatcatcacgctctacctgggggccgtggtgcaggcctga

SEQ ID NO: 1550 - RNA, 2037 nt, synthetic construct
  misc_feature 1..2037: note = derived and/or modified CDS sequence (opt1) from DENV-3 Consensus__SSopt-prME(S311R)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtccgggagacccagcacgggaccatcctcatcaaggtggagtacaagggcgaggacgtgccgtgcaagatccccttctccacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagctccatcgggaagatgttcgaggcgaccgcccggggcgcccgccgcatggccatcctgggcgacacggcctgggacttcgggagcgtgggcggggtgctcaactccctgggcaagatggtccaccagatcttcgggagcgcgtacaccgccctgttctccggcgtgagctgggtgatgaagatcggcatcggggtcctcctgacctggatcggcctgaactccaagaacaccagcatgtccttcagctgcatcgccatcgggatcatcacgctctacctgggcgccgtggtgcaggcctga

SEQ ID NO: 1551 - RNA, 2037 nt, synthetic construct
  misc_feature 1..2037: note = derived and/or modified CDS sequence (opt1) from DENV-3 Consensus__SSopt-prME(K321T)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcacggtggagtacaagggcgaggacgtgccgtgcaagatccccttcagcaccgaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgacggcccgcggcgcccggcgcatggccatcctgggcgacaccgcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacgtccatgagcttctcctgcatcgccatcgggatcatcaccctctacctgggcgccgtggtgcaggcctga

SEQ ID NO: 1552 - RNA, 2037 nt, synthetic construct
  misc_feature 1..2037: note = derived and/or modified CDS sequence (opt1) from DENV-3 Consensus__SSopt-prME(G28C,H242C)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcactgcggctgcgtgaccacgatggccaagaacaagcccaccctcgacatcgagctgcagaagaccgaggccacccagctggcgacgctccgcaagctgtgcatcgaggggaagatcaccaacatcaccaccgacagccggtgccccacgcagggcgaggccaccctgccggaggagcaggaccagaactacgtgtgcaagcacacctacgtcgaccgcggctgggggaacggctgcggcctcttcgggaaggggtccctggtgacctgcgccaagttccagtgcctggagcccatcgagggcaaggtggtccagtacgagaacctcaagtacacggtgatcatcaccgtgcacaccggcgaccagcaccaggtcgggaacgagacccagggcgtgacggccgagatcacgccccaggccagcaccaccgaggcgatcctgcccgagtacgggaccctgggcctcgagtgctccccgcggaccgggctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcctgcgccaagaagcaggaggtggtcgtgctgggctcccaggagggggcgatgcacacggccctcaccggcgccaccgagatccagaacagcgggggcacctccatcttcgccgggcacctgaagtgccgcctgaagatggacaagctcgagctgaagggcatgagctacgccatgtgcacgaacaccttcgtgctgaagaaggaggtctccgagacccagcacggcaccatcctcatcaaggtggagtacaagggggaggacgtgccgtgcaagatccccttcagcacggaggacggccaggggaaggcgcacaacggccggctgatcaccgccaaccccgtcgtgaccaagaaggaggagcccgtgaacatcgaggccgagccgcccttcggcgagagcaacatcgtcatcgggatcggcgacaacgccctgaagatcaactggtacaagaaggggtccagcatcggcaagatgttcgaggcgaccgcccgcggggcccggcgcatggccatcctgggcgacacggcctgggacttcggctccgtcgggggcgtgctcaacagcctggggaagatggtgcaccagatcttcggctccgcgtacaccgccctgttcagcggggtgtcctgggtgatgaagatcggcatcggcgtcctcctgacctggatcgggctgaacagcaagaacacctccatgagcttctcctgcatcgccatcggcatcatcacgctctacctgggggccgtggtgcaggcctga

SEQ ID NO: 1553 - RNA, 2037 nt, synthetic construct
  misc_feature 1..2037: note = derived and/or modified CDS sequence (opt1) from DENV-3 Consensus__SSopt-prME(R186L,A265T)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgctgaccggcctggacttcaacgagatgatcctcctgaccatgaagaacaaggcctggatggtccaccggcagtggttcttcgacctgcccctcccctggaccagcggcgccaccacggagacccccacctggaaccgcaaggagctgctggtgaccttcaagaacgcccacgccaagaagcaggaggtggtcgtgctcgggtcccaggagggcgcgatgcacacggccctgaccgggaccaccgagatccagaacagcggcgggacgtccatcttcgccggccacctgaagtgccggctcaagatggacaagctggagctgaagggcatgagctacgccatgtgcaccaacaccttcgtgctcaagaaggaggtctccgagacccagcacgggacgatcctgatcaaggtggagtacaagggcgaggacgtgccgtgcaagatccccttcagcaccgaggacgggcagggcaaggcccacaacggccgcctgatcaccgcgaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggccacggcgcggggcgcccgccggatggccatcctcggcgacaccgcctgggacttcgggtccgtgggcggggtgctgaacagcctgggcaagatggtccaccagatcttcgggtccgcctacaccgccctcttcagcggcgtgtcctgggtgatgaagatcggcatcggggtcctgctgacctggatcggcctcaacagcaagaacacgtccatgagcttctcctgcatcgcgatcgggatcatcaccctgtacctgggcgccgtggtgcaggcctga

SEQ ID NO: 1554 - RNA, 2037 nt, synthetic construct
  misc_feature 1..2037: note = derived and/or modified CDS sequence (opt1) from DENV-3 Consensus__SSopt-pr(D104A)ME(F108S)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggccaagcgctccgtcgcgctcgcgccccacgtgggcatggggctggacacccggacccagacctggatgagcgccgagggcgcctggcgccaggtggagaaggtcgagacgtgggccctgcggcacccggggttcaccatcctcgccctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggcgacccagctggccacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctctccgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcgtccaccaccgaggccatcctgcccgagtacggcaccctggggctcgagtgcagcccgcggaccggcctggacttcaacgagatgatcctgctcaccatgaagaacaaggcctggatggtccaccgccagtggttcttcgacctgcccctgccctggacctccggcgccaccacggagacccccacctggaaccggaaggagctcctggtgaccttcaagaacgcccacgcgaagaagcaggaggtggtcgtgctggggagccaggagggcgccatgcacacggccctcaccggggccaccgagatccagaactccggcgggaccagcatcttcgccggccacctgaagtgccgcctgaagatggacaagctcgagctgaagggcatgtcctacgcgatgtgcacgaacaccttcgtgctgaagaaggaggtcagcgagacccagcacgggaccatcctcatcaaggtggagtacaagggcgaggacgtgccgtgcaagatccccttcagcacggaggacgggcagggcaaggcccacaacggccggctgatcaccgccaaccccgtcgtgaccaagaaggaggagcccgtgaacatcgaggccgagccgcccttcggggagtccaacatcgtcatcggcatcggggacaacgcgctgaagatcaactggtacaagaagggcagctccatcgggaagatgttcgaggccaccgcccgcggcgcccggcgcatggccatcctgggcgacacggcgtgggacttcgggagcgtgggcggggtgctcaactccctgggcaagatggtccaccagatcttcgggagcgcctacaccgccctgttctccggcgtgagctgggtgatgaagatcggcatcggggtcctcctgacctggatcggcctgaactccaagaacaccagcatgtccttcagctgcatcgccatcgggatcatcacgctctacctgggcgccgtggtgcaggcgtga

SEQ ID NO: 1555 - RNA, 2037 nt, synthetic construct
  misc_feature 1..2037: note = derived and/or modified CDS sequence (opt1) from DENV-3 Consensus__SSopt-pr(D104A)ME(R186L,A265T)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggccaagcgctccgtcgcgctcgcgccccacgtgggcatggggctggacacccggacccagacctggatgagcgccgagggcgcctggcgccaggtggagaaggtcgagacgtgggccctgcggcacccggggttcaccatcctcgccctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggcgacccagctggccacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcgagcaccaccgaggccatcctgcccgagtacggcaccctggggctcgagtgctccccgctgaccggcctggacttcaacgagatgatcctcctgaccatgaagaacaaggcctggatggtccaccggcagtggttcttcgacctgcccctcccctggaccagcggcgccaccacggagacccccacctggaaccgcaaggagctgctggtgaccttcaagaacgcccacgcgaagaagcaggaggtggtcgtgctcgggtcccaggagggcgccatgcacacggccctgaccgggaccaccgagatccagaacagcggcgggacgtccatcttcgccggccacctgaagtgccggctcaagatggacaagctggagctgaagggcatgagctacgccatgtgcaccaacaccttcgtgctcaagaaggaggtctccgagacccagcacgggacgatcctgatcaaggtggagtacaagggcgaggacgtgccgtgcaagatccccttcagcaccgaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgacggcccggggcgcccgccggatggccatcctcggcgacaccgcctgggacttcgggtccgtgggcggggtgctgaacagcctgggcaagatggtccaccagatcttcgggtccgcgtacaccgccctcttcagcggcgtgtcctgggtgatgaagatcggcatcggggtcctgctgacctggatcggcctcaacagcaagaacacgtccatgagcttctcctgcatcgccatcgggatcatcaccctgtacctgggcgccgtggtgcaggcctga

SEQ ID NO: 1556 - RNA, 2037 nt, synthetic construct
  misc_feature 1..2037: note = derived and/or modified CDS sequence (opt1) from DENV-3 Consensus__SSopt-pr(D104A)ME(F108S,R186L,A265T)
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggccaagcgctccgtcgcgctcgcgccccacgtgggcatggggctggacacccggacccagacctggatgagcgccgagggcgcctggcgccaggtggagaaggtcgagacgtgggccctgcggcacccggggttcaccatcctcgccctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggcgacccagctggccacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctctccgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcgtccaccaccgaggccatcctgcccgagtacggcaccctggggctcgagtgcagcccgctgaccggcctggacttcaacgagatgatcctcctgaccatgaagaacaaggcctggatggtccaccggcagtggttcttcgacctgcccctcccctggacctccggcgccaccacggagacccccacctggaaccgcaaggagctgctggtgaccttcaagaacgcccacgcgaagaagcaggaggtggtcgtgctcgggagccaggagggcgccatgcacacggccctgaccgggaccaccgagatccagaactccggcgggacgagcatcttcgccggccacctgaagtgccggctcaagatggacaagctggagctgaagggcatgtcctacgccatgtgcaccaacaccttcgtgctcaagaaggaggtcagcgagacccagcacgggacgatcctgatcaaggtggagtacaagggcgaggacgtgccgtgcaagatccccttcagcaccgaggacgggcagggcaaggcgcacaacggccgcctgatcaccgccaaccccgtcgtgaccaagaaggaggagcccgtgaacatcgaggccgagccgcccttcggggagtccaacatcgtcatcggcatcggggacaacgccctgaagatcaactggtacaagaagggcagctccatcgggaagatgttcgaggcgacggcccggggcgcccgccggatggccatcctcggcgacaccgcctgggacttcgggagcgtgggcggggtgctgaactccctgggcaagatggtccaccagatcttcgggagcgcgtacaccgccctcttctccggcgtgagctgggtgatgaagatcggcatcggggtcctgctgacctggatcggcctcaactccaagaacacgagcatgtccttcagctgcatcgccatcgggatcatcaccctgtacctgggcgccgtggtgcaggcctga

SEQ ID NO: 1557 - RNA, 2016 nt, synthetic construct
  misc_feature 1..2016: note = derived and/or modified CDS sequence (opt1) from DENV-3 Consensus__SSopt-prMEdel101-107,(R99P,F108N)
  source 1..2016: mol_type = other RNA
atgaagcgcaagaagaccagcctgtgcctcatgatgatcctgcccgccgccctggcgttccacctcacctcccgggacggcgagccccgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccccgggaacggcaaggggtccctcgtgacctgcgccaagttccagtgcctggagcccatcgagggcaaggtggtccagtacgagaacctgaagtacacggtgatcatcaccgtgcacaccggggaccagcaccaggtcggcaacgagacccagggcgtgacggccgagatcacgccccaggccagcaccaccgaggcgatcctcccggagtacgggaccctgggcctggagtgcagcccccgcaccgggctcgacttcaacgagatgatcctgctgaccatgaagaacaaggcctggatggtccaccggcagtggttcttcgacctccccctgccctggacctccggcgccaccacggagaccccgacctggaaccgcaaggagctgctcgtgaccttcaagaacgcccacgccaagaagcaggaggtggtcgtgctggggtcccaggagggcgcgatgcacacggccctgaccggcgccaccgagatccagaacagcgggggcacctccatcttcgccgggcacctcaagtgccggctgaagatggacaagctggagctcaagggcatgagctacgccatgtgcacgaacaccttcgtgctgaagaaggaggtctccgagacccagcacgggaccatcctgatcaaggtggagtacaagggcgaggacgtgccctgcaagatccccttcagcacggaggacggccaggggaaggcgcacaacggccgcctcatcaccgccaaccccgtcgtgaccaagaaggaggagccggtgaacatcgaggccgagccgcccttcggggagagcaacatcgtcatcggcatcggcgacaacgccctgaagatcaactggtacaagaaggggtccagcatcggcaagatgttcgaggcgaccgcccgcggggcccggcggatggccatcctgggcgacacggcctgggacttcgggtccgtgggcggcgtgctgaacagcctcgggaagatggtccaccagatcttcggctccgcgtacaccgccctgttcagcggggtgtcctgggtgatgaagatcggcatcggggtcctgctcacctggatcggcctgaacagcaagaacacctccatgagcttctcctgcatcgccatcggcatcatcacgctgtacctcggggccgtggtgcaggcctga

SEQ ID NO: 1558 - RNA, 2037 nt, synthetic construct
  misc_feature 1..2037: note = derived and/or modified CDS sequence (opt1) from DENV-3 Consensus__SSopt-prMEdelstem_TM-JEV
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccaccctggggaaggcgttcagcacgaccctcaagggcgcccagcgcctggccgccctgggcgacaccgcctgggacttcgggtccatcggcggggtgttcaacagcatcggccgggcggtgcaccaggtcttcgggggcgccttccgcaccctcttcggcgggatgtcctggatcacgcagggcctgatgggggccctgctcctgtggatgggcgtgaacgcccgcgaccggagcatcgccctggcgttcctcgccaccgggggcgtgctggtcttcctggccaccaacgtgcacgcctga

SEQ ID NO: 1559 - RNA, 2037 nt, synthetic construct
  misc_feature 1..2037: note = derived and/or modified CDS sequence (opt1) from DENV-3 Consensus__SSopt-pr(D104A)MEdelstem_TM,(F108S)-JEV
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggccaagcgctccgtcgcgctcgcgccccacgtgggcatggggctggacacccggacccagacctggatgagcgccgagggcgcctggcgccaggtggagaaggtcgagacgtgggccctgcggcacccggggttcaccatcctcgccctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggcgacccagctggccacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctctccgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcgtccaccaccgaggccatcctgcccgagtacggcaccctggggctcgagtgcagcccgcggaccggcctggacttcaacgagatgatcctgctcaccatgaagaacaaggcctggatggtccaccgccagtggttcttcgacctgcccctgccctggacctccggcgccaccacggagacccccacctggaaccggaaggagctcctggtgaccttcaagaacgcccacgcgaagaagcaggaggtggtcgtgctggggagccaggagggcgccatgcacacggccctcaccggggccaccgagatccagaactccggcgggaccagcatcttcgccggccacctgaagtgccgcctgaagatggacaagctcgagctgaagggcatgtcctacgcgatgtgcacgaacaccttcgtgctgaagaaggaggtcagcgagacccagcacgggaccatcctcatcaaggtggagtacaagggcgaggacgtgccgtgcaagatccccttcagcacggaggacgggcagggcaaggcccacaacggccggctgatcaccgccaaccccgtcgtgaccaagaaggaggagcccgtgaacatcgaggccgagccgcccttcggggagtccaacatcgtcatcggcatcggggacaacgcgctgaagatcaactggtacaagaagggcagcaccctggggaaggccttctccacgaccctcaagggcgcccagcgcctggccgccctgggcgacaccgcgtgggacttcgggagcatcggcggggtgttcaactccatcggccgggccgtgcaccaggtcttcgggggcgccttccgcaccctcttcggcgggatgagctggatcacgcagggcctgatgggggccctgctcctgtggatgggcgtgaacgcccgcgaccggtccatcgcgctggccttcctcgccaccgggggcgtgctggtcttcctggccaccaacgtgcacgcctga

SEQ ID NO: 1560 - RNA, 2037 nt, synthetic construct
  misc_feature 1..2037: note = derived and/or modified CDS sequence (opt1) from DENV-3 Consensus__SSopt-pr(D104A)MEdelstem_TM,(R186L,A265T)-JEV
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggccaagcgctccgtcgcgctcgcgccccacgtgggcatggggctggacacccggacccagacctggatgagcgccgagggcgcctggcgccaggtggagaaggtcgagacgtgggccctgcggcacccggggttcaccatcctcgccctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggcgacccagctggccacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcgagcaccaccgaggccatcctgcccgagtacggcaccctggggctcgagtgctccccgctgaccggcctggacttcaacgagatgatcctcctgaccatgaagaacaaggcctggatggtccaccggcagtggttcttcgacctgcccctcccctggaccagcggcgccaccacggagacccccacctggaaccgcaaggagctgctggtgaccttcaagaacgcccacgcgaagaagcaggaggtggtcgtgctcgggtcccaggagggcgccatgcacacggccctgaccgggaccaccgagatccagaacagcggcgggacgtccatcttcgccggccacctgaagtgccggctcaagatggacaagctggagctgaagggcatgagctacgccatgtgcaccaacaccttcgtgctcaagaaggaggtctccgagacccagcacgggacgatcctgatcaaggtggagtacaagggcgaggacgtgccgtgcaagatccccttcagcaccgaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccacgctcgggaaggcgttcagcaccaccctgaagggcgcccagcggctggccgccctcggcgacaccgcctgggacttcgggtccatcggcggggtgttcaacagcatcggccgcgcggtgcaccaggtcttcgggggcgccttccggacgctgttcggcgggatgtcctggatcacccagggcctgatgggggccctcctgctgtggatgggcgtgaacgcccgcgaccgcagcatcgccctcgcgttcctggccaccgggggcgtgctggtcttcctcgccaccaacgtgcacgcctga

SEQ ID NO: 1561 - RNA, 2037 nt, synthetic construct
  misc_feature 1..2037: note = derived and/or modified CDS sequence (opt1) from DENV-3 Consensus__SSopt-pr(D104A)MEdelstem_TM,(F108S,R186L,A265T)- JEV
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggccaagcgctccgtcgcgctcgcgccccacgtgggcatggggctggacacccggacccagacctggatgagcgccgagggcgcctggcgccaggtggagaaggtcgagacgtgggccctgcggcacccggggttcaccatcctcgccctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggcgacccagctggccacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctctccgggaagggcagcctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggcgtccaccaccgaggccatcctgcccgagtacggcaccctggggctcgagtgcagcccgctgaccggcctggacttcaacgagatgatcctcctgaccatgaagaacaaggcctggatggtccaccggcagtggttcttcgacctgcccctcccctggacctccggcgccaccacggagacccccacctggaaccgcaaggagctgctggtgaccttcaagaacgcccacgcgaagaagcaggaggtggtcgtgctcgggagccaggagggcgccatgcacacggccctgaccgggaccaccgagatccagaactccggcgggacgagcatcttcgccggccacctgaagtgccggctcaagatggacaagctggagctgaagggcatgtcctacgccatgtgcaccaacaccttcgtgctcaagaaggaggtcagcgagacccagcacgggacgatcctgatcaaggtggagtacaagggcgaggacgtgccgtgcaagatccccttcagcaccgaggacgggcagggcaaggcgcacaacggccgcctgatcaccgccaaccccgtcgtgaccaagaaggaggagcccgtgaacatcgaggccgagccgcccttcggggagtccaacatcgtcatcggcatcggggacaacgccctgaagatcaactggtacaagaagggcagcacgctcgggaaggcgttctccaccaccctgaagggcgcccagcggctggccgccctcggcgacaccgcctgggacttcgggagcatcggcggggtgttcaactccatcggccgcgcggtgcaccaggtcttcgggggcgccttccggacgctgttcggcgggatgagctggatcacccagggcctgatgggggccctcctgctgtggatgggcgtgaacgcccgcgaccgctccatcgccctcgcgttcctggccaccgggggcgtgctggtcttcctcgccaccaacgtgcacgcctga

SEQ ID NO: 1562 - RNA, 2037 nt, synthetic construct
  misc_feature 1..2037: note = derived and/or modified CDS sequence (opt1) from DENV-3 Consensus__SSopt-prMEdelstem_TM,(H259N)-JEV
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcggaccggcctggacttcaacgagatgatcctgctcaccatgaagaacaaggcctggatggtccaccgccagtggttcttcgacctgcccctgccctggaccagcggcgccaccacggagacccccacctggaaccggaaggagctcctggtgaccttcaagaacgcccacgccaagaagcaggaggtggtcgtgctggggtcccaggagggcgcgatgaacacggccctcaccggggccaccgagatccagaacagcggcgggacctccatcttcgccggccacctgaagtgccgcctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccggctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccaccctggggaaggcgttcagcacgaccctcaagggcgcccagcgcctggccgccctgggcgacaccgcctgggacttcgggtccatcggcggggtgttcaacagcatcggccgggcggtgcaccaggtcttcgggggcgccttccgcaccctcttcggcgggatgtcctggatcacgcagggcctgatgggggccctgctcctgtggatgggcgtgaacgcccgcgaccggagcatcgccctggcgttcctcgccaccgggggcgtgctggtcttcctggccaccaacgtgcacgcctga

SEQ ID NO: 1563 - RNA, 2037 nt, synthetic construct
  misc_feature 1..2037: note = derived and/or modified CDS sequence (opt1) from DENV-3 Consensus__SSopt-prMEdelstem_TM,(R186L,A265T)-JEV
  source 1..2037: mol_type = other RNA
atgaagcgcaagaagaccagcctgtgcctcatgatgatcctgcccgccgccctggcgttccacctcacctcccgggacggcgagccgcgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccgcgggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgctgaccggcctggacttcaacgagatgatcctcctgaccatgaagaacaaggcctggatggtccaccggcagtggttcttcgacctgcccctcccctggaccagcggcgccaccacggagacccccacctggaaccgcaaggagctgctggtgaccttcaagaacgcccacgccaagaagcaggaggtggtcgtgctcgggtcccaggagggcgcgatgcacacggccctgaccgggaccaccgagatccagaacagcggcgggacgtccatcttcgccggccacctgaagtgccggctcaagatggacaagctggagctgaagggcatgagctacgccatgtgcaccaacaccttcgtgctcaagaaggaggtctccgagacccagcacgggacgatcctgatcaaggtggagtacaagggcgaggacgtgccgtgcaagatccccttcagcaccgaggacgggcagggcaaggcccacaacggccgcctgatcaccgcgaaccccgtcgtgaccaagaaggaggagcccgtgaacatcgaggccgagccgcccttcggggagagcaacatcgtcatcggcatcggggacaacgccctgaagatcaactggtacaagaagggctccacgctcgggaaggccttcagcaccaccctgaagggcgcgcagcggctggccgccctcggcgacaccgcctgggacttcgggtccatcggcggggtgttcaacagcatcggccgcgccgtgcaccaggtcttcgggggcgcgttccggacgctgttcggcgggatgtcctggatcacccagggcctgatgggggccctcctgctgtggatgggcgtgaacgcccgcgaccgcagcatcgccctcgccttcctggcgaccgggggcgtgctggtcttcctcgccaccaacgtgcacgcctga

SEQ ID NO: 1564 - RNA, 2016 nt, synthetic construct
  misc_feature 1..2016: note = derived and/or modified CDS sequence (opt1) from DENV-3 Consensus__SSopt-prMEdelstem_TM,del101-107,(R99P,F108N)-JEV
  source 1..2016: mol_type = other RNA
atgaagcgcaagaagaccagcctgtgcctcatgatgatcctgcccgccgccctggcgttccacctcacctcccgggacggcgagccccgcatgatcgtggggaagaacgagcggggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccgccgggacaagcgctccgtcgccctcgcgccccacgtgggcatggggctggacacccggacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcgctgcgtgggggtgggcaaccgggacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccgcaagctgtgcatcgagggcaagatcaccaacatcaccaccgacagccggtgccccacgcagggcgaggccaccctgccggaggagcaggaccagaactacgtgtgcaagcacacctacgtcgaccccgggaacggcaaggggtccctcgtgacctgcgccaagttccagtgcctggagcccatcgagggcaaggtggtccagtacgagaacctgaagtacacggtgatcatcaccgtgcacaccggggaccagcaccaggtcggcaacgagacccagggcgtgacggccgagatcacgccccaggccagcaccaccgaggcgatcctcccggagtacgggaccctgggcctggagtgcagcccccgcaccgggctcgacttcaacgagatgatcctgctgaccatgaagaacaaggcctggatggtccaccggcagtggttcttcgacctccccctgccctggacctccggcgccaccacggagaccccgacctggaaccgcaaggagctgctcgtgaccttcaagaacgcccacgccaagaagcaggaggtggtcgtgctggggtcccaggagggcgcgatgcacacggccctgaccggcgccaccgagatccagaacagcgggggcacctccatcttcgccgggcacctcaagtgccggctgaagatggacaagctggagctcaagggcatgagctacgccatgtgcacgaacaccttcgtgctgaagaaggaggtctccgagacccagcacgggaccatcctgatcaaggtggagtacaagggcgaggacgtgccctgcaagatccccttcagcacggaggacggccaggggaaggcgcacaacggccgcctcatcaccgccaaccccgtcgtgaccaagaaggaggagccggtgaacatcgaggccgagccgcccttcggggagagcaacatcgtcatcggcatcggcgacaacgccctgaagatcaactggtacaagaaggggtccaccctgggcaaggcgttcagcacgaccctgaagggggcccagcggctcgccgccctgggcgacaccgcctgggacttcgggtccatcggcggcgtgttcaacagcatcgggcgcgcggtgcaccaggtcttcggcggggccttccggaccctgttcggcgggatgtcctggatcacgcagggcctcatgggcgccctgctgctctggatgggggtgaacgcccgcgaccgcagcatcgccctggcgttcctggccaccggcggggtgctcgtcttcctggccaccaacgtgcacgcctga

SEQ ID NO: 1565 - RNA, 3081 nt, synthetic construct
  misc_feature 1..3081: note = derived and/or modified CDS sequence (opt1) from DENV-3 Consensus__SSc-prME-NS1
  source 1..3081: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcgccaggtggagaaggtcgagacgtgggccctgcggcacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcacgccccaggccagcaccaccgaggcgatcctgcccgagtacggcaccctggggctcgagtgctccccgcgcaccggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctcatcaaggtggagtacaagggcgaggacgtgccgtgcaagatccccttcagcacggaggacgggcagggcaaggcgcacaacggccgcctgatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatggggtgcgtcatcaactggaagggcaaggagctgaagtgcggcagcgggatcttcgtgaccaacgaggtgcacacctggaccgagcagtacaagttccaggcggactcccccaagcgcctcgccacggccatcgccggcgcctgggagaacggggtctgcggcatccgcagcaccacccggatggagaacctgctgtggaagcagatcgcgaacgagctcaactacatcctgtgggagaacaacatcaagctgaccgtggtggtcggggacatcatcggcgtgctcgagcagggcaagcgcacgctgacgccccagccgatggagctgaagtactcctggaagacctgggggaaggccaagatcgtgaccgccgagacccagaacagctccttcatcatcgacggccccaacacccccgagtgccccagcgtctcccgggcctggaacgtgtgggaggtggaggactacgggttcggcgtcttcaccaccaacatctggctcaagctgcgcgaggtgtacacccagctgtgcgaccaccggctcatgagcgcggccgtgaaggacgagcgcgccgtccacgccgacatgggctactggatcgagagccagaagaacgggtcctggaagctggagaaggccagcctgatcgaggtgaagacgtgcacctggccgaagtcccacaccctctggagcaacggcgtgctggagtccgacatgatcatccccaagagcctggcggggcccatctcccagcacaaccaccggccgggctaccacacccagacggccgggccctggcacctcggcaagctggagctggacttcaactactgcgagggcaccaccgtcgtgatcaccgagaactgcgggacgcgcggccccagcctccggaccaccaccgtgtccgggaagctgatccacgagtggtgctgccgcagctgcacgctgcccccgctccggtacatgggcgaggacgggtgctggtacggcatggagatccgccccatctccgagaaggaggagaacatggtcaagagcctggtgtccgcctga

SEQ ID NO: 1566 - RNA, 1824 nt, synthetic construct
  misc_feature 1..1824: note = derived and/or modified CDS sequence (opt1) from DENV-3 Consensus__SSm-EdelTM-linker-ferritin
  source 1..1824: mol_type = other RNA
atgacccagaaggtggtcatcttcatcctgctcatgctggtgacccccagcatgacgatgcgctgcgtgggcgtcgggaaccgggacttcgtggagggcctgtccggggccacctgggtggacgtcgtgctcgagcacggcgggtgcgtgaccaccatggccaagaacaagccgacgctggacatcgagctgcagaagaccgaggcgacccagctcgccaccctgcgcaagctgtgcatcgagggcaagatcacgaacatcaccaccgacagccggtgccccacccagggcgaggccacgctccccgaggagcaggaccagaactacgtctgcaagcacacctacgtggaccgcgggtggggcaacgggtgcggcctgttcgggaagggctccctggtgacctgcgccaagttccagtgcctcgagcccatcgagggcaaggtcgtgcagtacgagaacctgaagtacaccgtgatcatcacggtccacaccggggaccagcaccaggtgggcaacgagacccagggggtgaccgccgagatcacgccgcaggcgagcaccaccgaggccatcctgcccgagtacggcaccctcggcctggagtgcagcccccggacggggctggacttcaacgagatgatcctcctgaccatgaagaacaaggcctggatggtccaccgccagtggttcttcgacctgcccctcccgtggacctccggcgccaccacggagacccccacctggaaccggaaggagctgctggtgaccttcaagaacgcgcacgccaagaagcaggaggtggtcgtgctcgggtcccaggagggcgccatgcacacggccctgaccggggccaccgagatccagaacagcggcggcacctccatcttcgcggggcacctgaagtgccgcctcaagatggacaagctggagctgaagggcatgagctacgccatgtgcacgaacaccttcgtgctcaagaaggaggtctccgagacccagcacgggaccatcctgatcaaggtggagtacaagggcgaggacgtcccctgcaagatccccttcagcaccgaggacgggcagggcaaggcccacaacggccggctgatcacggccaacccggtggtgaccaagaaggaggagcccgtcaacatcgaggccgagccgcccttcggggagtccaacatcgtgatcggcatcggggacaacgcgctcaagatcaactggtacaagaagggcagctccatcgggaagatgttcgaggccaccgcccgcggcgcccggcgcatggccatcctgggcgacaccgcgtgggacttcgggagctccggcggggacatcatcaagctgctcaacgagcaggtcaacaaggagatgcagagctccaacctgtacatgagcatgagctcctggtgctacacgcacagcctggacggcgccggcctcttcctgttcgaccacgccgccgaggagtacgagcacgccaagaagctgatcatcttcctcaacgagaacaacgtgcccgtgcagctgacctccatcagcgcgcccgagcacaagttcgaggggctgacccagatcttccagaaggcctacgagcacgagcagcacatctccgagagcatcaacaacatcgtggaccacgccatcaagtccaaggaccacgccaccttcaacttcctccagtggtacgtcgcggagcagcacgaggaggaggtgctgttcaaggacatcctggacaagatcgagctcatcggcaacgagaaccacgggctgtacctggccgaccagtacgtgaagggcatcgccaagagccggaagtcctga

SEQ ID NO: 1567 - RNA, 1821 nt, synthetic construct
  misc_feature 1..1821: note = derived and/or modified CDS sequence (opt1) from DENV-3 Consensus__SStPA-WHbcAg-linker-EdelTM
  source 1..1821: mol_type = other RNA
atggacgccatgaagcgcggcctgtgctgcgtgctcctgctgtgcggggccgtcttcgtggacagcgtgaccggcatggacatcgacccctacaaggagttcgggtccagctaccagctcctgaacttcctgccgctcgacttcttccccgacctgaacgcgctggtcgacaccgccacggccctctacgaggaggagctgaccggccgggagcactgcagcccccaccacaccgccatccgccaggccctggtgtgctgggacgagctcaccaagctgatcgcgtggatgtcctccaacatcacgagcgagcaggtccggaccatcatcgtgaaccacgtgaacgacacctgggggctgaaggtgcgccagtccctctggttccacctgagctgcctgaccttcggccagcacacggtccaggagttcctcgtgtccttcggcgtgtggatccggacccccgccccgtaccgcccgcccaacgcccccatcctgagcaccctgcccgagcacaccgtcatctgcgggggcgggggctccgggggcggcgggatgcggtgcgtgggcgtggggaaccgcgacttcgtcgagggcctcagcggcgccacgtgggtggacgtggtcctggagcacgggggctgcgtgaccaccatggcgaagaacaagcccaccctggacatcgagctccagaagacggaggccacccagctggccaccctgcggaagctctgcatcgaggggaagatcaccaacatcacgaccgactcccgctgccccacccagggcgaggccaccctgcccgaggagcaggaccagaactacgtgtgcaagcacacgtacgtcgaccgggggtggggcaacggctgcgggctgttcggcaaggggagcctcgtgacctgcgccaagttccagtgcctggagccgatcgagggcaaggtggtccagtacgagaacctgaagtacaccgtgatcatcaccgtccacacgggggaccagcaccaggtgggcaacgagacccagggcgtgaccgcggagatcacgccccaggcctccaccaccgaggccatcctccccgagtacgggaccctgggcctggagtgcagcccccgcaccgggctcgacttcaacgagatgatcctgctgacgatgaagaacaaggcctggatggtccaccggcagtggttcttcgacctcccgctgccctggacctccggcgccaccaccgagacccccacgtggaaccgcaaggagctgctcgtgaccttcaagaacgcgcacgccaagaagcaggaggtggtcgtgctggggagccaggagggcgccatgcacaccgccctgaccggcgccacggagatccagaactccgggggcaccagcatcttcgcggggcacctcaagtgccggctgaagatggacaagctggagctcaagggcatgagctacgccatgtgcaccaacaccttcgtgctgaagaaggaggtctccgagacgcagcacggcaccatcctgatcaaggtggagtacaagggggaggacgtgccctgcaagatcccgttcagcaccgaggacggccaggggaaggcccacaacggccgcctgatcaccgccaaccccgtcgtgacgaagaaggaggagcccgtgaacatcgaggccgagcccccgttcggggagtccaacatcgtcatcggcatcggcgacaacgcgctcaagatcaactggtacaagaaggggagctccatcggcaagatgttcgaggccaccgcccgcggggcccggcggatggcgatcctgggcgacaccgcctgggacttcgggagctga

SEQ ID NO: 1568 - RNA, 75 nt, synthetic construct
  misc_feature 1..75: note = derived and/or modified CDS sequence (opt2) from Homo sapiens__SigSeq(TPA)/SStPA
  source 1..75: mol_type = other RNA
atggacgccatgaagcgcggcctctgctgcgtcctcctcctctgcggcgccgtcttcgtcgactccgtcaccggc

SEQ ID NO: 1569 - RNA, 489 nt, synthetic construct
  misc_feature 1..489: note = derived and/or modified CDS sequence (opt2) from Helicobacter pylori J99__Ferritin
  source 1..489: mol_type = other RNA
gacatcatcaagctcctcaacgagcaggtcaacaaggagatgcagtcctccaacctctacatgtccatgtcctcctggtgctacacccactccctcgacggcgccggcctcttcctcttcgaccacgccgccgaggagtacgagcacgccaagaagctcatcatcttcctcaacgagaacaacgtccccgtccagctcacctccatctccgcccccgagcacaagttcgagggcctcacccagatcttccagaaggcctacgagcacgagcagcacatctccgagtccatcaacaacatcgtcgaccacgccatcaagtccaaggaccacgccaccttcaacttcctccagtggtacgtcgccgagcagcacgaggaggaggtcctcttcaaggacatcctcgacaagatcgagctcatcggcaacgagaaccacggcctctacctcgccgaccagtacgtcaagggcatcgccaagtcccgcaagtcc

SEQ ID NO: 1570 - RNA, 450 nt, synthetic construct
  misc_feature 1..450: note = derived and/or modified CDS sequence (opt2) from Woodchuck hepatitis virus__WHbcAg
  source 1..450: mol_type = other RNA
atggacatcgacccctacaaggagttcggctcctcctaccagctcctcaacttcctccccctcgacttcttccccgacctcaacgccctcgtcgacaccgccaccgccctctacgaggaggagctcaccggccgcgagcactgctccccccaccacaccgccatccgccaggccctcgtctgctgggacgagctcaccaagctcatcgcctggatgtcctccaacatcacctccgagcaggtccgcaccatcatcgtcaaccacgtcaacgacacctggggcctcaaggtccgccagtccctctggttccacctctcctgcctcaccttcggccagcacaccgtccaggagttcctcgtctccttcggcgtctggatccgcacccccgccccctaccgcccccccaacgcccccatcctctccaccctccccgagcacaccgtcatctgc

SEQ ID NO: 1571 - RNA, 303 nt, synthetic construct
  misc_feature 1..303: note = derived and/or modified CDS sequence (opt2) from Japanese encephalitis virus__Cterm-JEV/JEV
  source 1..303: mol_type = other RNA
ggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcc

SEQ ID NO: 1572 - RNA, 15 nt, synthetic construct
  misc_feature 1..15: note = derived and/or modified CDS sequence (opt2) from Artificial__MKRKK
  source 1..15: mol_type = other RNA
atgaagcgcaagaag

SEQ ID NO: 1573 - skipped

SEQ ID NO: 1574 - RNA, 27 nt, synthetic construct
  misc_feature 1..27: note = derived and/or modified CDS sequence (opt2) from Artificial__Linker(G4SG4)
  source 1..27: mol_type = other RNA
ggcggcggcggctccggcggcggcggc

SEQ ID NO: 1575 - RNA, 51 nt, synthetic construct
  misc_feature 1..51: note = derived and/or modified CDS sequence (opt2) from Foot-and-mouth disease virus__F2A/P2A
  source 1..51: mol_type = other RNA
aacttcgacctcctcaagctcgccggcgacgtcgagtccaaccccggcccc

SEQ ID NO: 1576 - RNA, 300 nt, synthetic construct
  misc_feature 1..300: note = derived and/or modified CDS sequence (opt2) from DENV-1 CYD23__C
  source 1..300: mol_type = other RNA
atgaacaaccagcgcaagaagaccgcccgcccctccttcaacatgctcaagcgcgcccgcaaccgcgtctccaccgtctcccagctcgccaagcgcttctccaagggcctcctctccggccagggccccatgaagctcgtcatggccttcatcgccttcctccgcttcctcgccatcccccccaccgccggcatcctcgcccgctggggctccttcaagaagaacggcgccatcaaggtcctccgcggcttcaagaaggagatctccaacatgctcaacatcatgaaccgccgccgcaag

SEQ ID NO: 1577 - RNA, 342 nt, synthetic construct
  misc_feature 1..342: note = derived and/or modified CDS sequence (opt2) from DENV-1 CYD23__C-SSc
  source 1..342: mol_type = other RNA
atgaacaaccagcgcaagaagaccgcccgcccctccttcaacatgctcaagcgcgcccgcaaccgcgtctccaccgtctcccagctcgccaagcgcttctccaagggcctcctctccggccagggccccatgaagctcgtcatggccttcatcgccttcctccgcttcctcgccatcccccccaccgccggcatcctcgcccgctggggctccttcaagaagaacggcgccatcaaggtcctccgcggcttcaagaaggagatctccaacatgctcaacatcatgaaccgccgccgcaagtccgtcaccatgctcctcatgctcatgcccaccgccctcgcc

SEQ ID NO: 1578 - RNA, 273 nt, synthetic construct
  misc_feature 1..273: note = derived and/or modified CDS sequence (opt2) from DENV-1 CYD23__pr
  source 1..273: mol_type = other RNA
ttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgc

SEQ ID NO: 1579 - RNA, 225 nt, synthetic construct
  misc_feature 1..225: note = derived and/or modified CDS sequence (opt2) from DENV-1 CYD23__M
  source 1..225: mol_type = other RNA
tccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggcc

SEQ ID NO: 1580 - RNA, 498 nt, synthetic construct
  misc_feature 1..498: note = derived and/or modified CDS sequence (opt2) from DENV-1 CYD23__prM
  source 1..498: mol_type = other RNA
ttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggcc

SEQ ID NO: 1581 - RNA, 1485 nt, synthetic construct
  misc_feature 1..1485: note = derived and/or modified CDS sequence (opt2) from DENV-1 CYD23__E
  source 1..1485: mol_type = other RNA
atgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcc

SEQ ID NO: 1582 - RNA, 1983 nt, synthetic construct
  misc_feature 1..1983: note = derived and/or modified CDS sequence (opt2) from DENV-1 CYD23__prME
  source 1..1983: mol_type = other RNA
ttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcc

SEQ ID NO: 1583 - RNA, 2025 nt, synthetic construct
  misc_feature 1..2025: note = derived and/or modified CDS sequence (opt2) from DENV-1 CYD23__SSc-prME
  source 1..2025: mol_type = other RNA
tccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcc

SEQ ID NO: 1584 - RNA, 2325 nt, synthetic construct
  misc_feature 1..2325: note = derived and/or modified CDS sequence (opt2) from DENV-1 CYD23__C-prME
  source 1..2325: mol_type = other RNA
atgaacaaccagcgcaagaagaccgcccgcccctccttcaacatgctcaagcgcgcccgcaaccgcgtctccaccgtctcccagctcgccaagcgcttctccaagggcctcctctccggccagggccccatgaagctcgtcatggccttcatcgccttcctccgcttcctcgccatcccccccaccgccggcatcctcgcccgctggggctccttcaagaagaacggcgccatcaaggtcctccgcggcttcaagaaggagatctccaacatgctcaacatcatgaaccgccgccgcaagtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcc

SEQ ID NO: 1585 - RNA, 45 nt, synthetic construct
  misc_feature 1..45: note = derived and/or modified CDS sequence (opt2) from DENV-1 CYD23__SSc
  source 1..45: mol_type = other RNA
atgtccgtcaccatgctcctcatgctcatgcccaccgccctcgcc

SEQ ID NO: 1586 - RNA, 57 nt, synthetic construct
  misc_feature 1..57: note = derived and/or modified CDS sequence (opt2) from DENV-1 CYD23__SSopt
  source 1..57: mol_type = other RNA
atgaagcgcaagaagtccgtcaccatgctcctcatgctcatgcccaccgccctcgcc

SEQ ID NO: 1587 - RNA, 57 nt, synthetic construct
  misc_feature 1..57: note = derived and/or modified CDS sequence (opt2) from DENV-1 CYD23__SSm
  source 1..57: mol_type = other RNA
atgacccagaagggcatcatcttcatcctcctcatgctcgtcaccccctccatggcc

SEQ ID NO: 1588 - RNA, 1488 nt, synthetic construct
  misc_feature 1..1488: note = derived and/or modified CDS sequence (opt2) from DENV-1 CYD23__E
  source 1..1488: mol_type = other RNA
atgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcctga

SEQ ID NO: 1589 - RNA, 1182 nt, synthetic construct
  misc_feature 1..1182: note = derived and/or modified CDS sequence (opt2) from DENV-1 CYD23__EdelTM-variant (aa1-394)
  source 1..1182: mol_type = other RNA
atgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaag

SEQ ID NO: 1590 - RNA, 1275 nt, synthetic construct
  misc_feature 1..1275: note = derived and/or modified CDS sequence (opt2) from DENV-1 CYD23__EdelTM-variant (aa1-424)
  source 1..1275: mol_type = other RNA
atgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctcctga

SEQ ID NO: 1591 - RNA, 1266 nt, synthetic construct
  misc_feature 1..1266: note = derived and/or modified CDS sequence (opt2) from DENV-1 CYD23__EdelTM-variant (aa1-421)
  source 1..1266: mol_type = other RNA
atgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggactga

SEQ ID NO: 1592 - RNA, 2031 nt, synthetic construct
  misc_feature 1..2031: note = derived and/or modified CDS sequence (opt2) from DENV-1 CYD23__SSc-prME
  source 1..2031: mol_type = other RNA
atgtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcctga

SEQ ID NO: 1593 - RNA, 2031 nt, synthetic construct
  misc_feature 1..2031: note = derived and/or modified CDS sequence (opt2) from DENV-1 CYD23__SSc-prME(F108S)
  source 1..2031: mol_type = other RNA
atgtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctctccggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcctga

SEQ ID NO: 1594 - RNA, 2031 nt, synthetic construct
  misc_feature 1..2031: note = derived and/or modified CDS sequence (opt2) from DENV-1 CYD23__SSc-prMEdelstem_TM-JEV
  source 1..2031: mol_type = other RNA
atgtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1595 - RNA, 2379 nt, synthetic construct
  misc_feature 1..2379: note = derived and/or modified CDS sequence (opt2) from DENV-1 CYD23__C-P2A-SSc-prME
  source 1..2379: mol_type = other RNA
atgaacaaccagcgcaagaagaccgcccgcccctccttcaacatgctcaagcgcgcccgcaaccgcgtctccaccgtctcccagctcgccaagcgcttctccaagggcctcctctccggccagggccccatgaagctcgtcatggccttcatcgccttcctccgcttcctcgccatcccccccaccgccggcatcctcgcccgctggggctccttcaagaagaacggcgccatcaaggtcctccgcggcttcaagaaggagatctccaacatgctcaacatcatgaaccgccgccgcaagaacttcgacctcctcaagctcgccggcgacgtcgagtccaaccccggcccctccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcctcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcctga

SEQ ID NO: 1596 - RNA, 2043 nt, synthetic construct
  misc_feature 1..2043: note = derived and/or modified CDS sequence (opt2) from DENV-1 CYD23__SSopt-prME(F108S)
  source 1..2043: mol_type = other RNA
atgaagcgcaagaagtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctctccggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcctga

SEQ ID NO: 1597 - RNA, 2043 nt, synthetic construct
  misc_feature 1..2043: note = derived and/or modified CDS sequence (opt2) from DENV-1 CYD23__SSopt-prME(F96H)
  source 1..2043: mol_type = other RNA
atgaagcgcaagaagtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcacccacgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcctga

SEQ ID NO: 1598 - RNA, 2043 nt, synthetic construct
  misc_feature 1..2043: note = derived and/or modified CDS sequence (opt2) from DENV-1 CYD23__SSopt-prME(S186F)
  source 1..2043: mol_type = other RNA
atgaagcgcaagaagtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgcttcccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcctga

SEQ ID NO: 1599 - RNA, 2043 nt, synthetic construct
  misc_feature 1..2043: note = derived and/or modified CDS sequence (opt2) from DENV-1 CYD23__SSopt-prME(R188L)
  source 1..2043: mol_type = other RNA
atgaagcgcaagaagtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctcccccctcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctccatcggcggcgtcttcacctccgtcggcaagctcgtccaccagatcttcggcaccgcctacggcgtcctcttctccggcgtctcctggaccatgaagatcggcatcggcgtcctcctcacctggctcggcctcaactcccgctccacctccctctccatgacctgcatcgccgtcggcctcgtcaccctctacctcggcgtcatggtccaggcctga

SEQ ID NO: 1600 - RNA, 2043 nt, synthetic construct
  misc_feature 1..2043: note = derived and/or modified CDS sequence (opt2) from DENV-1 CYD23__SSopt-pr(D104A)MEdelstem_TM,(F108S)-JEV
  source 1..2043: mol_type = other RNA
atgaagcgcaagaagtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgccaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctctccggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1601 - RNA, 2043 nt, synthetic construct
  misc_feature 1..2043: note = derived and/or modified CDS sequence (opt2) from DENV-1 CYD23__SSopt-prMEdelstem_TM,(H261N)-JEV
  source 1..2043: mol_type = other RNA
atgaagcgcaagaagtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgaacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1602 - RNA, 2043 nt, synthetic construct
  misc_feature 1..2043: note = derived and/or modified CDS sequence (opt2) from DENV-1 CYD23__SSopt-prMEdelstem_TM,(R188L,A267T)-JEV
  source 1..2043: mol_type = other RNA
atgaagcgcaagaagtccgtcaccatgctcctcatgctcatgcccaccgccctcgccttccacctcaccacccgcggcggcgagccccacatgatcgtctccaagcaggagcgcggcaagtccctcctcttcaagacctccgccggcgtcaacatgtgcaccctcatcgccatggacctcggcgagctctgcgaggacaccatgacctacaagtgcccccgcatcaccgaggccgagcccgacgacgtcgactgctggtgcaacgccaccgacacctgggtcacctacggcacctgctcccagaccggcgagcaccgccgcgacaagcgctccgtcgccctcgccccccacgtcggcctcggcctcgagacccgcaccgagacctggatgtcctccgagggcgcctggaagcagatccagcgcgtcgagacctgggccctccgccaccccggcttcaccgtcatcgccctcttcctcgcccacgccatcggcacctccatcacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctcccccctcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcaccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1603 - RNA, 300 nt, synthetic construct
  misc_feature 1..300: note = derived and/or modified CDS sequence (opt2) from DENV-2 CYD2-T__C
  source 1..300: mol_type = other RNA
atgaacaaccagcgcaagaaggccaagaacacccccttcaacatgctcaagcgcgagcgcaaccgcgtctccaccgtccagcagctcaccaagcgcttctccctcggcatgctccagggccgcggccccctcaagctcttcatggccctcgtcgccttcctccgcttcctcaccatcccccccaccgccggcatcctcaagcgctggggcaccatcaagaagtccaaggccatcaacgtcctccgcggcttccgcaaggagatcggccgcatgctcaacatcctcaaccgccgccgccgc

SEQ ID NO: 1604 - RNA, 342 nt, synthetic construct
  misc_feature 1..342: note = derived and/or modified CDS sequence (opt2) from DENV-2 CYD2-T__C-SSc
  source 1..342: mol_type = other RNA
atgaacaaccagcgcaagaaggccaagaacacccccttcaacatgctcaagcgcgagcgcaaccgcgtctccaccgtccagcagctcaccaagcgcttctccctcggcatgctccagggccgcggccccctcaagctcttcatggccctcgtcgccttcctccgcttcctcaccatcccccccaccgccggcatcctcaagcgctggggcaccatcaagaagtccaaggccatcaacgtcctccgcggcttccgcaaggagatcggccgcatgctcaacatcctcaaccgccgccgccgctccgccggcatgatcatcatgctcatccccaccgtcatggcc

SEQ ID NO: 1605 - RNA, 273 nt, synthetic construct
  misc_feature 1..273: note = derived and/or modified CDS sequence (opt2) from DENV-2 CYD2-T__pr
  source 1..273: mol_type = other RNA
ttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgc

SEQ ID NO: 1606 - RNA, 225 nt, synthetic construct
  misc_feature 1..225: note = derived and/or modified CDS sequence (opt2) from DENV-2 CYD2-T__M
  source 1..225: mol_type = other RNA
tccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgacc

SEQ ID NO: 1607 - RNA, 498 nt, synthetic construct
  misc_feature 1..498: note = derived and/or modified CDS sequence (opt2) from DENV-2 CYD2-T__prM
  source 1..498: mol_type = other RNA
ttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgacc

SEQ ID NO: 1608 - RNA, 1485 nt, synthetic construct
  misc_feature 1..1485: note = derived and/or modified CDS sequence (opt2) from DENV-2 CYD2-T__E
  source 1..1485: mol_type = other RNA
atgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcc

SEQ ID NO: 1609 - RNA, 1983 nt, synthetic construct
  misc_feature 1..1983: note = derived and/or modified CDS sequence (opt2) from DENV-2 CYD2-T__prME
  source 1..1983: mol_type = other RNA
ttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcc

SEQ ID NO: 1610 - RNA, 2025 nt, synthetic construct
  misc_feature 1..2025: note = derived and/or modified CDS sequence (opt2) from DENV-2 CYD2-T__SSc-prME
  source 1..2025: mol_type = other RNA
tccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcc

SEQ ID NO: 1611 - RNA, 2325 nt, synthetic construct
  misc_feature 1..2325: note = derived and/or modified CDS sequence (opt2) from DENV-2 CYD2-T__C-prME
  source 1..2325: mol_type = other RNA
atgaacaaccagcgcaagaaggccaagaacacccccttcaacatgctcaagcgcgagcgcaaccgcgtctccaccgtccagcagctcaccaagcgcttctccctcggcatgctccagggccgcggccccctcaagctcttcatggccctcgtcgccttcctccgcttcctcaccatcccccccaccgccggcatcctcaagcgctggggcaccatcaagaagtccaaggccatcaacgtcctccgcggcttccgcaaggagatcggccgcatgctcaacatcctcaaccgccgccgccgctccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcc

SEQ ID NO: 1612 - RNA, 45 nt, synthetic construct
  misc_feature 1..45: note = derived and/or modified CDS sequence (opt2) from DENV-2 CYD2-T__SSc
  source 1..45: mol_type = other RNA
atgtccgccggcatgatcatcatgctcatccccaccgtcatggcc

SEQ ID NO: 1613 - RNA, 57 nt, synthetic construct
  misc_feature 1..57: note = derived and/or modified CDS sequence (opt2) from DENV-2 CYD2-T__SSopt
  source 1..57: mol_type = other RNA
atgaagcgcaagaagtccgccggcatgatcatcatgctcatccccaccgtcatggcc

SEQ ID NO: 1614 - RNA, 57 nt, synthetic construct
  misc_feature 1..57: note = derived and/or modified CDS sequence (opt2) from DENV-2 CYD2-T__SSm
  source 1..57: mol_type = other RNA
atgttccagcgcgccctcatcttcatcctcctcaccgccgtcaccccctccatgacc

SEQ ID NO: 1615 - RNA, 1488 nt, synthetic construct
  misc_feature 1..1488: note = derived and/or modified CDS sequence (opt2) from DENV-2 CYD2-T__E
  source 1..1488: mol_type = other RNA
atgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcctga

SEQ ID NO: 1616 - RNA, 1182 nt, synthetic construct
  misc_feature 1..1182: note = derived and/or modified CDS sequence (opt2) from DENV-2 CYD2-T__EdelTM-variant (aa1-394)
  source 1..1182: mol_type = other RNA
atgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaag

SEQ ID NO: 1617 - RNA, 1272 nt, synthetic construct
  misc_feature 1..1272: note = derived and/or modified CDS sequence (opt2) from DENV-2 CYD2-T__EdelTM-variant (aa1-424)
  source 1..1272: mol_type = other RNA
atgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctcc

SEQ ID NO: 1618 - RNA, 1263 nt, synthetic construct
  misc_feature 1..1263: note = derived and/or modified CDS sequence (opt2) from DENV-2 CYD2-T__EdelTM-variant (aa1-421)
  source 1..1263: mol_type = other RNA
atgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggac

SEQ ID NO: 1619 - RNA, 2031 nt, synthetic construct
  misc_feature 1..2031: note = derived and/or modified CDS sequence (opt2) from DENV-2 CYD2-T__SSc-prME
  source 1..2031: mol_type = other RNA
atgtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcctga

SEQ ID NO: 1620 - RNA, 2031 nt, synthetic construct
  misc_feature 1..2031: note = derived and/or modified CDS sequence (opt2) from DENV-2 CYD2-T__SSc-prME(F108S)
  source 1..2031: mol_type = other RNA
atgtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctctccggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcctga

SEQ ID NO: 1621 - RNA, 2031 nt, synthetic construct
  misc_feature 1..2031: note = derived and/or modified CDS sequence (opt2) from DENV-2 CYD2-T__SSc-prMEdelstem_TM-JEV
  source 1..2031: mol_type = other RNA
atgtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1622 - RNA, 1332 nt, synthetic construct
  misc_feature 1..1332: note = derived and/or modified CDS sequence (opt2) from DENV-2 CYD2-T__SSm-EdelTM
  source 1..1332: mol_type = other RNA
atgttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctcctga

SEQ ID NO: 1623 - RNA, 2379 nt, synthetic construct
  misc_feature 1..2379: note = derived and/or modified CDS sequence (opt2) from DENV-2 CYD2-T__C-P2A-SSc-prME
  source 1..2379: mol_type = other RNA
atgaacaaccagcgcaagaaggccaagaacacccccttcaacatgctcaagcgcgagcgcaaccgcgtctccaccgtccagcagctcaccaagcgcttctccctcggcatgctccagggccgcggccccctcaagctcttcatggccctcgtcgccttcctccgcttcctcaccatcccccccaccgccggcatcctcaagcgctggggcaccatcaagaagtccaaggccatcaacgtcctccgcggcttccgcaaggagatcggccgcatgctcaacatcctcaaccgccgccgccgcaacttcgacctcctcaagctcgccggcgacgtcgagtccaaccccggcccctccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcctga

SEQ ID NO: 1624 - RNA, 2043 nt, synthetic construct
  misc_feature 1..2043: note = derived and/or modified CDS sequence (opt2) from DENV-2 CYD2-T__SSopt-prME(F108S)
  source 1..2043: mol_type = other RNA
atgaagcgcaagaagtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctctccggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcctga

SEQ ID NO: 1625 - RNA, 2043 nt, synthetic construct
  misc_feature 1..2043: note = derived and/or modified CDS sequence (opt2) from DENV-2 CYD2-T__SSopt-prME(M96H)
  source 1..2043: mol_type = other RNA
atgaagcgcaagaagtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactcccacgtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcctga

SEQ ID NO: 1626 - RNA, 2043 nt, synthetic construct
  misc_feature 1..2043: note = derived and/or modified CDS sequence (opt2) from DENV-2 CYD2-T__SSopt-prME(S186F)
  source 1..2043: mol_type = other RNA
atgaagcgcaagaagtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgcttcccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcctga

SEQ ID NO: 1627 - RNA, 2043 nt, synthetic construct
  misc_feature 1..2043: note = derived and/or modified CDS sequence (opt2) from DENV-2 CYD2-T__SSopt-prME(R188L)
  source 1..2043: mol_type = other RNA
atgaagcgcaagaagtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctcccccctcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtcaccctcgtcctcgtcggcatcgtcaccctctacctcggcgtcatggtccaggcctga

SEQ ID NO: 1628 - RNA, 2043 nt, synthetic construct
  misc_feature 1..2043: note = derived and/or modified CDS sequence (opt2) from DENV-2 CYD2-T__SSopt-pr(D104A)MEdelstem_TM,(F108S)-JEV
  source 1..2043: mol_type = other RNA
atgaagcgcaagaagtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgccaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctctccggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1629 - RNA, 2043 nt, synthetic construct
  misc_feature 1..2043: note = derived and/or modified CDS sequence (opt2) from DENV-2 CYD2-T__SSopt-prMEdelstem_TM,(H261N)-JEV
  source 1..2043: mol_type = other RNA
atgaagcgcaagaagtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgaacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1630 - RNA, 2043 nt, synthetic construct
  misc_feature 1..2043: note = derived and/or modified CDS sequence (opt2) from DENV-2 CYD2-T__SSopt-prMEdelstem_TM,(R188L,A267T)-JEV
  source 1..2043: mol_type = other RNA
atgaagcgcaagaagtccgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccatgggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatgatggccgccatcctcgcctacaccatcggcaccacccacttccagcgcgccctcatcttcatcctcctcaccgccgtcaccccctccatgaccatgcgctgcatcggcatgtccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttccgctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctcccccctcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcaccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1631 - RNA, 297 nt, synthetic construct
  misc_feature 1..297: note = derived and/or modified CDS sequence (opt2) from DENV-4 Consensus__C
  source 1..297: mol_type = other RNA
atgaaccagcgcaagaaggtcgtccgcccccccttcaacatgctcaagcgcgagcgcaaccgcgtctccaccccccagggcctcgtcaagcgcttctccaccggcctcttctccggcaagggccccctccgcatggtcctcgccttcatcaccttcctccgcgtcctctccatcccccccaccgccggcatcctcaagcgctggggccagctcaagaagaacaaggccatcaagatcctcatcggcttccgcaaggagatcggccgcatgctcaacatcctcaacggccgcaagcgc

SEQ ID NO: 1632 - RNA, 339 nt, synthetic construct
  misc_feature 1..339: note = derived and/or modified CDS sequence (opt2) from DENV-4 Consensus__C-SSc
  source 1..339: mol_type = other RNA
atgaaccagcgcaagaaggtcgtccgcccccccttcaacatgctcaagcgcgagcgcaaccgcgtctccaccccccagggcctcgtcaagcgcttctccaccggcctcttctccggcaagggccccctccgcatggtcctcgccttcatcaccttcctccgcgtcctctccatcccccccaccgccggcatcctcaagcgctggggccagctcaagaagaacaaggccatcaagatcctcatcggcttccgcaaggagatcggccgcatgctcaacatcctcaacggccgcaagcgctccaccatcaccctcctctgcctcatccccaccgtcatggcc

SEQ ID NO: 1633 - RNA, 273 nt, synthetic construct
  misc_feature 1..273: note = derived and/or modified CDS sequence (opt2) from DENV-4 Consensus__pr
  source 1..273: mol_type = other RNA
ttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgc

SEQ ID NO: 1634 - RNA, 225 nt, synthetic construct
  misc_feature 1..225: note = derived and/or modified CDS sequence (opt2) from DENV-4 Consensus__M
  source 1..225: mol_type = other RNA
tccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggc

SEQ ID NO: 1635 - RNA, 498 nt, synthetic construct
  misc_feature 1..498: note = derived and/or modified CDS sequence (opt2) from DENV-4 Consensus__prM
  source 1..498: mol_type = other RNA
ttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggc

SEQ ID NO: 1636 - RNA, 1485 nt, synthetic construct
  misc_feature 1..1485: note = derived and/or modified CDS sequence (opt2) from DENV-4 Consensus__E
  source 1..1485: mol_type = other RNA
atgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcc

SEQ ID NO: 1637 - RNA, 1983 nt, synthetic construct
  misc_feature 1..1983: note = derived and/or modified CDS sequence (opt2) from DENV-4 Consensus__prME
  source 1..1983: mol_type = other RNA
ttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcc

SEQ ID NO: 1638 - RNA, 2025 nt, synthetic construct
  misc_feature 1..2025: note = derived and/or modified CDS sequence (opt2) from DENV-4 Consensus__SSc-prME
  source 1..2025: mol_type = other RNA
tccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcc

SEQ ID NO: 1639 - RNA, 2322 nt, synthetic construct
  misc_feature 1..2322: note = derived and/or modified CDS sequence (opt2) from DENV-4 Consensus__C-prME
  source 1..2322: mol_type = other RNA
atgaaccagcgcaagaaggtcgtccgcccccccttcaacatgctcaagcgcgagcgcaaccgcgtctccaccccccagggcctcgtcaagcgcttctccaccggcctcttctccggcaagggccccctccgcatggtcctcgccttcatcaccttcctccgcgtcctctccatcccccccaccgccggcatcctcaagcgctggggccagctcaagaagaacaaggccatcaagatcctcatcggcttccgcaaggagatcggccgcatgctcaacatcctcaacggccgcaagcgctccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcc

SEQ ID NO: 1640 - RNA, 45 nt, synthetic construct
  misc_feature 1..45: note = derived and/or modified CDS sequence (opt2) from DENV-4 Consensus__SSc
  source 1..45: mol_type = other RNA
atgtccaccatcaccctcctctgcctcatccccaccgtcatggcc

SEQ ID NO: 1641 - RNA, 57 nt, synthetic construct
  misc_feature 1..57: note = derived and/or modified CDS sequence (opt2) from DENV-4 Consensus__SSopt
  source 1..57: mol_type = other RNA
atgaagcgcaagaagtccaccatcaccctcctctgcctcatccccaccgtcatggcc

SEQ ID NO: 1642 - RNA, 57 nt, synthetic construct
  misc_feature 1..57: note = derived and/or modified CDS sequence (opt2) from DENV-4 Consensus__SSm
  source 1..57: mol_type = other RNA
atgatccagcgcaccgtcttcttcgtcctcatgatgctcgtcgccccctcctacggc

SEQ ID NO: 1643 - RNA, 1488 nt, synthetic construct
  misc_feature 1..1488: note = derived and/or modified CDS sequence (opt2) from DENV-4 Consensus__E
  source 1..1488: mol_type = other RNA
atgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcctga

SEQ ID NO: 1644 - RNA, 1182 nt, synthetic construct
  misc_feature 1..1182: note = derived and/or modified CDS sequence (opt2) from DENV-4 Consensus__EdelTM-variant (aa1-394)
  source 1..1182: mol_type = other RNA
atgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaag

SEQ ID NO: 1645 - RNA, 1272 nt, synthetic construct
  misc_feature 1..1272: note = derived and/or modified CDS sequence (opt2) from DENV-4 Consensus__EdelTM-variant (aa1-424)
  source 1..1272: mol_type = other RNA
atgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctcc

SEQ ID NO: 1646 - RNA, 1266 nt, synthetic construct
  misc_feature 1..1266: note = derived and/or modified CDS sequence (opt2) from DENV-4 Consensus__EdelTM-variant (aa1-421)
  source 1..1266: mol_type = other RNA
atgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggactga

SEQ ID NO: 1647 - RNA, 2031 nt, synthetic construct
  misc_feature 1..2031: note = derived and/or modified CDS sequence (opt2) from DENV-4 Consensus__SSc-prME
  source 1..2031: mol_type = other RNA
atgtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcctga

SEQ ID NO: 1648 - RNA, 2031 nt, synthetic construct
  misc_feature 1..2031: note = derived and/or modified CDS sequence (opt2) from DENV-4 Consensus__SSc-prME(F108S)
  source 1..2031: mol_type = other RNA
atgtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctctccggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcctga

SEQ ID NO: 1649 - RNA, 2031 nt, synthetic construct
  misc_feature 1..2031: note = derived and/or modified CDS sequence (opt2) from DENV-4 Consensus__SSc-prMEdelstem_TM-JEV
  source 1..2031: mol_type = other RNA
atgtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1650 - RNA, 1332 nt, synthetic construct
  misc_feature 1..1332: note = derived and/or modified CDS sequence (opt2) from DENV-4 Consensus__SSm-EdelTM
  source 1..1332: mol_type = other RNA
atgatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctcctga

SEQ ID NO: 1651 - RNA, 2376 nt, synthetic construct
  misc_feature 1..2376: note = derived and/or modified CDS sequence (opt2) from DENV-4 Consensus__C-P2A-SSc-prME
  source 1..2376: mol_type = other RNA
atgaaccagcgcaagaaggtcgtccgcccccccttcaacatgctcaagcgcgagcgcaaccgcgtctccaccccccagggcctcgtcaagcgcttctccaccggcctcttctccggcaagggccccctccgcatggtcctcgccttcatcaccttcctccgcgtcctctccatcccccccaccgccggcatcctcaagcgctggggccagctcaagaagaacaaggccatcaagatcctcatcggcttccgcaaggagatcggccgcatgctcaacatcctcaacggccgcaagcgcaacttcgacctcctcaagctcgccggcgacgtcgagtccaaccccggcccctccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcctga

SEQ ID NO: 1652 - RNA, 2043 nt, synthetic construct
  misc_feature 1..2043: note = derived and/or modified CDS sequence (opt2) from DENV-4 Consensus__SSopt-prME(F108S)
  source 1..2043: mol_type = other RNA
atgaagcgcaagaagtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctctccggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcctga

SEQ ID NO: 1653 - RNA, 2043 nt, synthetic construct
  misc_feature 1..2043: note = derived and/or modified CDS sequence (opt2) from DENV-4 Consensus__SSopt-prME(V96H)
  source 1..2043: mol_type = other RNA
atgaagcgcaagaagtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgaccacgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcctga

SEQ ID NO: 1654 - RNA, 2043 nt, synthetic construct
  misc_feature 1..2043: note = derived and/or modified CDS sequence (opt2) from DENV-4 Consensus__SSopt-prME(E186F)
  source 1..2043: mol_type = other RNA
atgaagcgcaagaagtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcttcccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcctga

SEQ ID NO: 1655 - RNA, 2043 nt, synthetic construct
  misc_feature 1..2043: note = derived and/or modified CDS sequence (opt2) from DENV-4 Consensus__SSopt-prME(R188L)
  source 1..2043: mol_type = other RNA
atgaagcgcaagaagtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagcccctctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctcctccatcggcaagatgttcgagtccacctaccgcggcgccaagcgcatggccatcctcggcgagaccgcctgggacttcggctccgtcggcggcctcttcacctccctcggcaaggccgtccaccaggtcttcggctccgtctacaccaccatgttcggcggcgtctcctggatgatccgcatcctcatcggcttcctcgtcctctggatcggcaccaactcccgcaacacctccatggccatgacctgcatcgccgtcggcggcatcaccctcttcctcggcttcaccgtccaggcctga

SEQ ID NO: 1656 - RNA, 2043 nt, synthetic construct
  misc_feature 1..2043: note = derived and/or modified CDS sequence (opt2) from DENV-4 Consensus__SSopt-pr(D104A)MEdelstem_TM,(F108S)-JEV
  source 1..2043: mol_type = other RNA
atgaagcgcaagaagtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgccaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctctccggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1657 - RNA, 2043 nt, synthetic construct
  misc_feature 1..2043: note = derived and/or modified CDS sequence (opt2) from DENV-4 Consensus__SSopt-prMEdelstem_TM,(H261N)-JEV
  source 1..2043: mol_type = other RNA
atgaagcgcaagaagtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagccccgctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgaactccgccctcgccggcgccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1658 - RNA, 2043 nt, synthetic construct
  misc_feature 1..2043: note = derived and/or modified CDS sequence (opt2) from DENV-4 Consensus__SSopt-prMEdelstem_TM,(R188L,A267T)-JEV
  source 1..2043: mol_type = other RNA
atgaagcgcaagaagtccaccatcaccctcctctgcctcatccccaccgtcatggccttccacctctccacccgcgacggcgagcccctcatgatcgtcgccaagcacgagcgcggccgccccctcctcttcaagaccaccgagggcatcaacaagtgcaccctcatcgccatggacctcggcgagatgtgcgaggacaccgtcacctacaagtgccccctcctcgtcaacaccgagcccgaggacatcgactgctggtgcaacctcacctccacctgggtcatgtacggcacctgcacccagtccggcgagcgccgccgcgagaagcgctccgtcgccctcaccccccactccggcatgggcctcgagacccgcgccgagacctggatgtcctccgagggcgcctggaagcacgcccagcgcgtcgagtcctggatcctccgcaaccccggcttcgccctcctcgccggcttcatggcctacatgatcggccagaccggcatccagcgcaccgtcttcttcgtcctcatgatgctcgtcgccccctcctacggcatgcgctgcgtcggcgtcggcaaccgcgacttcgtcgagggcgtctccggcggcgcctgggtcgacctcgtcctcgagcacggcggctgcgtcaccaccatggcccagggcaagcccaccctcgacttcgagctcaccaagaccaccgccaaggaggtcgccctcctccgcacctactgcatcgaggcctccatctccaacatcaccaccgccacccgctgccccacccagggcgagccctacctcaaggaggagcaggaccagcagtacatctgccgccgcgacgtcgtcgaccgcggctggggcaacggctgcggcctcttcggcaagggcggcgtcgtcacctgcgccaagttctcctgctccggcaagatcaccggcaacctcgtccagatcgagaacctcgagtacaccgtcgtcgtcaccgtccacaacggcgacacccacgccgtcggcaacgacacctccaaccacggcgtcaccgccaccatcaccccccgctccccctccgtcgaggtcaagctccccgactacggcgagctcaccctcgactgcgagcccctctccggcatcgacttcaacgagatgatcctcatgaagatgaagaagaagacctggctcgtccacaagcagtggttcctcgacctccccctcccctggaccgccggcgccgacacctccgaggtccactggaactacaaggagcgcatggtcaccttcaaggtcccccacgccaagcgccaggacgtcaccgtcctcggctcccaggagggcgccatgcactccgccctcgccggcaccaccgaggtcgactccggcgacggcaaccacatgttcgccggccacctcaagtgcaaggtccgcatggagaagctccgcatcaagggcatgtcctacaccatgtgctccggcaagttctccatcgacaaggagatggccgagacccagcacggcaccaccgtcgtcaaggtcaagtacgagggcgccggcgccccctgcaaggtccccatcgagatccgcgacgtcaacaaggagaaggtcgtcggccgcgtcatctcctccacccccctcgccgagaacaccaactccgtcaccaacatcgagctcgagccccccttcggcgactcctacatcgtcatcggcgtcggcaactccgccctcaccctccactggttccgcaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1659 - RNA, 300 nt, synthetic construct
  misc_feature 1..300: note = derived and/or modified CDS sequence (opt2) from DENV-3 Consensus__C
  source 1..300: mol_type = other RNA
atgaacaaccagcgcaagaagaccggcaagccctccatcaacatgctcaagcgcgtccgcaaccgcgtctccaccggctcccagctcgccaagcgcttctccaagggcctcctcaacggccagggccccatgaagctcgtcatggccttcatcgccttcctccgcttcctcgccatcccccccaccgccggcgtcctcgcccgctggggcaccttcaagaagtccggcgccatcaaggtcctcaagggcttcaagaaggagatctccaacatgctctccatcatcaacaagcgcaagaag

SEQ ID NO: 1660 - RNA, 342 nt, synthetic construct
  misc_feature 1..342: note = derived and/or modified CDS sequence (opt2) from DENV-3 Consensus__C-SSc
  source 1..342: mol_type = other RNA
atgaacaaccagcgcaagaagaccggcaagccctccatcaacatgctcaagcgcgtccgcaaccgcgtctccaccggctcccagctcgccaagcgcttctccaagggcctcctcaacggccagggccccatgaagctcgtcatggccttcatcgccttcctccgcttcctcgccatcccccccaccgccggcgtcctcgcccgctggggcaccttcaagaagtccggcgccatcaaggtcctcaagggcttcaagaaggagatctccaacatgctctccatcatcaacaagcgcaagaagacctccctctgcctcatgatgatcctccccgccgccctcgcc

SEQ ID NO: 1661 - RNA, 273 nt, synthetic construct
  misc_feature 1..273: note = derived and/or modified CDS sequence (opt2) from DENV-3 Consensus__pr
  source 1..273: mol_type = other RNA
ttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgc

SEQ ID NO: 1662 - RNA, 225 nt, synthetic construct
  misc_feature 1..225: note = derived and/or modified CDS sequence (opt2) from DENV-3 Consensus__M
  source 1..225: mol_type = other RNA
tccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgacc

SEQ ID NO: 1663 - RNA, 498 nt, synthetic construct
  misc_feature 1..498: note = derived and/or modified CDS sequence (opt2) from DENV-3 Consensus__prM
  source 1..498: mol_type = other RNA
ttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgacc

SEQ ID NO: 1664 - RNA, 1479 nt, synthetic construct
  misc_feature 1..1479: note = derived and/or modified CDS sequence (opt2) from DENV-3 Consensus__E
  source 1..1479: mol_type = other RNA
atgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcc

SEQ ID NO: 1665 - RNA, 1977 nt, synthetic construct
  misc_feature 1..1977: note = derived and/or modified CDS sequence (opt2) from DENV-3 Consensus__prME
  source 1..1977: mol_type = other RNA
ttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcc

SEQ ID NO: 1666 - RNA, 2019 nt, synthetic construct
  misc_feature 1..2019: note = derived and/or modified CDS sequence (opt2) from DENV-3 Consensus__SSc-prME
  source 1..2019: mol_type = other RNA
acctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcc

SEQ ID NO: 1667 - RNA, 1056 nt, synthetic construct
  misc_feature 1..1056: note = derived and/or modified CDS sequence (opt2) from DENV-3 Consensus__NS1
  source 1..1056: mol_type = other RNA
gacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgcc

SEQ ID NO: 1668 - RNA, 1857 nt, synthetic construct
  misc_feature 1..1857: note = derived and/or modified CDS sequence (opt2) from DENV-3 Consensus__NS3
  source 1..1857: mol_type = other RNA
tccggcgtcctctgggacgtcccctccccccccgagacccagaaggccgagctcgaggagggcgtctaccgcatcaagcagcagggcatcttcggcaagacccaggtcggcgtcggcgtccagaaggagggcgtcttccacaccatgtggcacgtcacccgcggcgccgtcctcacctacaacggcaagcgcctcgagcccaactgggcctccgtcaagaaggacctcatctcctacggcggcggctggcgcctctccgcccagtggcagaagggcgaggaggtccaggtcatcgccgtcgagcccggcaagaaccccaagaacttccagaccatgcccggcaccttccagaccaccaccggcgagatcggcgccatcgccctcgacttcaagcccggcacctccggctcccccatcatcaaccgcgagggcaaggtcgtcggcctctacggcaacggcgtcgtcaccaagaacggcggctacgtctccggcatcgcccagaccaacgccgagcccgacggccccacccccgagctcgaggaggagatgttcaagaagcgcaacctcaccatcatggacctccaccccggctccggcaagacccgcaagtacctccccgccatcgtccgcgaggccatcaagcgccgcctccgcaccctcatcctcgcccccacccgcgtcgtcgccgccgagatggaggaggccctcaagggcctccccatccgctaccagaccaccgccaccaagtccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcggcatgggcgaggccgccgccatcttcatgaccgccaccccccccggcaccgccgacgccttcccccagtccaacgcccccatccaggacgaggagcgcgacatccccgagcgctcctggaactccggcaacgagtggatcaccgacttcgccggcaagaccgtctggttcgtcccctccatcaaggccggcaacgacatcgccaactgcctccgcaagaacggcaagaaggtcatccagctctcccgcaagaccttcgacaccgagtaccagaagaccaagctcaacgactgggacttcgtcgtcaccaccgacatctccgagatgggcgccaacttcaaggccgaccgcgtcatcgacccccgccgctgcctcaagcccgtcatcctcaccgacggccccgagcgcgtcatcctcgccggccccatgcccgtcaccgccgcctccgccgcccagcgccgcggccgcgtcggccgcaacccccagaaggagaacgaccagtacatcttcaccggccagcccctcaacaacgacgaggaccacgcccactggaccgaggccaagatgctcctcgacaacatcaacacccccgagggcatcatccccgccctcttcgagcccgagcgcgagaagtccgccgccatcgacggcgagtaccgcctcaagggcgagtcccgcaagaccttcgtcgagctcatgcgccgcggcgacctccccgtctggctcgcccacaaggtcgcctccgagggcatcaagtacaccgaccgcaagtggtgcttcgacggccagcgcaacaaccagatcctcgaggagaacatggacgtcgagatctggaccaaggagggcgagaagaagaagctccgcccccgctggctcgacgcccgcacctactccgaccccctcgccctcaaggagttcaaggagttcgccgccggccgcaag

SEQ ID NO: 1669 - RNA, 2319 nt, synthetic construct
  misc_feature 1..2319: note = derived and/or modified CDS sequence (opt2) from DENV-3 Consensus__C-prME
  source 1..2319: mol_type = other RNA
atgaacaaccagcgcaagaagaccggcaagccctccatcaacatgctcaagcgcgtccgcaaccgcgtctccaccggctcccagctcgccaagcgcttctccaagggcctcctcaacggccagggccccatgaagctcgtcatggccttcatcgccttcctccgcttcctcgccatcccccccaccgccggcgtcctcgcccgctggggcaccttcaagaagtccggcgccatcaaggtcctcaagggcttcaagaaggagatctccaacatgctctccatcatcaacaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcc

SEQ ID NO: 1670 - RNA, 45 nt, synthetic construct
  misc_feature 1..45: note = derived and/or modified CDS sequence (opt2) from DENV-3 Consensus__SSc
  source 1..45: mol_type = other RNA
atgacctccctctgcctcatgatgatcctccccgccgccctcgcc

SEQ ID NO: 1671 - RNA, 57 nt, synthetic construct
  misc_feature 1..57: note = derived and/or modified CDS sequence (opt2) from DENV-3 Consensus__SSopt
  source 1..57: mol_type = other RNA
atgaagcgcaagaagacctccctctgcctcatgatgatcctccccgccgccctcgcc

SEQ ID NO: 1672 - RNA, 57 nt, synthetic construct
  misc_feature 1..57: note = derived and/or modified CDS sequence (opt2) from DENV-3 Consensus__SSm
  source 1..57: mol_type = other RNA
atgacccagaaggtcgtcatcttcatcctcctcatgctcgtcaccccctccatgacc

SEQ ID NO: 1673 - RNA, 1482 nt, synthetic construct
  misc_feature 1..1482: note = derived and/or modified CDS sequence (opt2) from DENV-3 Consensus__E
  source 1..1482: mol_type = other RNA
atgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1674 - RNA, 1176 nt, synthetic construct
  misc_feature 1..1176: note = derived and/or modified CDS sequence (opt2) from DENV-3 Consensus__EdelTM-variant (aa1-392)
  source 1..1176: mol_type = other RNA
atgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaag

SEQ ID NO: 1675 - RNA, 1269 nt, synthetic construct
  misc_feature 1..1269: note = derived and/or modified CDS sequence (opt2) from DENV-3 Consensus__EdelTM-variant (aa1-422)
  source 1..1269: mol_type = other RNA
atgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctcctga

SEQ ID NO: 1676 - RNA, 1260 nt, synthetic construct
  misc_feature 1..1260: note = derived and/or modified CDS sequence (opt2) from DENV-3 Consensus__EdelTM-variant (aa1-419)
  source 1..1260: mol_type = other RNA
atgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggactga

SEQ ID NO: 1677 - RNA, 1155 nt, synthetic construct
  misc_feature 1..1155: note = derived and/or modified CDS sequence (opt2) from DENV-3 Consensus__Edelaa101-107
  source 1..1155: mol_type = other RNA
atgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaag

SEQ ID NO: 1678 - RNA, 1173 nt, synthetic construct
  misc_feature 1..1173: note = derived and/or modified CDS sequence (opt2) from DENV-3 Consensus__EdelTM-variant (aa1-391)
  source 1..1173: mol_type = other RNA
atgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaag

SEQ ID NO: 1679 - RNA, 2025 nt, synthetic construct
  misc_feature 1..2025: note = derived and/or modified CDS sequence (opt2) from DENV-3 Consensus__SSc-prME
  source 1..2025: mol_type = other RNA
atgacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1680 - RNA, 2025 nt, synthetic construct
  misc_feature 1..2025: note = derived and/or modified CDS sequence (opt2) from DENV-3 Consensus__SSc-prME(F108S)
  source 1..2025: mol_type = other RNA
atgacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctctccggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1681 - RNA, 2025 nt, synthetic construct
  misc_feature 1..2025: note = derived and/or modified CDS sequence (opt2) from DENV-3 Consensus__SSc-prME(R186L)
  source 1..2025: mol_type = other RNA
atgacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctcccccctcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1682 - RNA, 2025 nt, synthetic construct
  misc_feature 1..2025: note = derived and/or modified CDS sequence (opt2) from DENV-3 Consensus__SSc-prME(A265T)
  source 1..2025: mol_type = other RNA
atgacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcaccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1683 - RNA, 2025 nt, synthetic construct
  misc_feature 1..2025: note = derived and/or modified CDS sequence (opt2) from DENV-3 Consensus__SSc-prMEdelstem_TM-JEV
  source 1..2025: mol_type = other RNA
atgacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1684 - RNA, 1326 nt, synthetic construct
  misc_feature 1..1326: note = derived and/or modified CDS sequence (opt2) from DENV-3 Consensus__SSm-EdelTM
  source 1..1326: mol_type = other RNA
atgacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctcctga

SEQ ID NO: 1685 - RNA, 2373 nt, synthetic construct
  misc_feature 1..2373: note = derived and/or modified CDS sequence (opt2) from DENV-3 Consensus__C-P2A-SSc-prME
  source 1..2373: mol_type = other RNA
atgaacaaccagcgcaagaagaccggcaagccctccatcaacatgctcaagcgcgtccgcaaccgcgtctccaccggctcccagctcgccaagcgcttctccaagggcctcctcaacggccagggccccatgaagctcgtcatggccttcatcgccttcctccgcttcctcgccatcccccccaccgccggcgtcctcgcccgctggggcaccttcaagaagtccggcgccatcaaggtcctcaagggcttcaagaaggagatctccaacatgctctccatcatcaacaagcgcaagaagaacttcgacctcctcaagctcgccggcgacgtcgagtccaaccccggccccacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1686 - RNA, 2037 nt, synthetic construct
  misc_feature 1..2037: note = derived and/or modified CDS sequence (opt2) from DENV-3 Consensus__SSopt-prME
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1687 - RNA, 2037 nt, synthetic construct
  misc_feature 1..2037: note = derived and/or modified CDS sequence (opt2) from DENV-3 Consensus__SSopt-prME(F108S)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctctccggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1688 - RNA, 2037 nt, synthetic construct
  misc_feature 1..2037: note = derived and/or modified CDS sequence (opt2) from DENV-3 Consensus__SSopt-prME(H27N)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagaacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1689 - RNA, 2037 nt, synthetic construct
  misc_feature 1..2037: note = derived and/or modified CDS sequence (opt2) from DENV-3 Consensus__SSopt-prME(T76I)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccatccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1690 - RNA, 2037 nt, synthetic construct
  misc_feature 1..2037: note = derived and/or modified CDS sequence (opt2) from DENV-3 Consensus__SSopt-prME(N89D)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccaggactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1691 - RNA, 2037 nt, synthetic construct
  misc_feature 1..2037: note = derived and/or modified CDS sequence (opt2) from DENV-3 Consensus__SSopt-prME(Y96H)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacccacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1692 - RNA, 2037 nt, synthetic construct
  misc_feature 1..2037: note = derived and/or modified CDS sequence (opt2) from DENV-3 Consensus__SSopt-prME(K110E)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcgagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1693 - RNA, 2037 nt, synthetic construct
  misc_feature 1..2037: note = derived and/or modified CDS sequence (opt2) from DENV-3 Consensus__SSopt-prME(H149N)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagaaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1694 - RNA, 2037 nt, synthetic construct
  misc_feature 1..2037: note = derived and/or modified CDS sequence (opt2) from DENV-3 Consensus__SSopt-prME(S184F)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgcttcccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1695 - RNA, 2037 nt, synthetic construct
  misc_feature 1..2037: note = derived and/or modified CDS sequence (opt2) from DENV-3 Consensus__SSopt-prME(R186L)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctcccccctcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1696 - RNA, 2037 nt, synthetic construct
  misc_feature 1..2037: note = derived and/or modified CDS sequence (opt2) from DENV-3 Consensus__SSopt-prME(N240S)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagtccgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1697 - RNA, 2037 nt, synthetic construct
  misc_feature 1..2037: note = derived and/or modified CDS sequence (opt2) from DENV-3 Consensus__SSopt-prME(M258L)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccctccacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1698 - RNA, 2037 nt, synthetic construct
  misc_feature 1..2037: note = derived and/or modified CDS sequence (opt2) from DENV-3 Consensus__SSopt-prME(H259N)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgaacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1699 - RNA, 2037 nt, synthetic construct
  misc_feature 1..2037: note = derived and/or modified CDS sequence (opt2) from DENV-3 Consensus__SSopt-prME(H259R)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcgcaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1700 - RNA, 2037 nt, synthetic construct
  misc_feature 1..2037: note = derived and/or modified CDS sequence (opt2) from DENV-3 Consensus__SSopt-prME(A265T)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcaccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1701 - RNA, 2037 nt, synthetic construct
  misc_feature 1..2037: note = derived and/or modified CDS sequence (opt2) from DENV-3 Consensus__SSopt-prME(S296G)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgggctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1702 - RNA, 2037 nt, synthetic construct
  misc_feature 1..2037: note = derived and/or modified CDS sequence (opt2) from DENV-3 Consensus__SSopt-prME(S311R)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtccgcgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1703 - RNA, 2037 nt, synthetic construct
  misc_feature 1..2037: note = derived and/or modified CDS sequence (opt2) from DENV-3 Consensus__SSopt-prME(K321T)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaccgtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1704 - RNA, 2037 nt, synthetic construct
  misc_feature 1..2037: note = derived and/or modified CDS sequence (opt2) from DENV-3 Consensus__SSopt-prME(G28C,H242C)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcactgcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcctgcgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1705 - RNA, 2037 nt, synthetic construct
  misc_feature 1..2037: note = derived and/or modified CDS sequence (opt2) from DENV-3 Consensus__SSopt-prME(R186L,A265T)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctcccccctcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcaccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1706 - RNA, 2037 nt, synthetic construct
  misc_feature 1..2037: note = derived and/or modified CDS sequence (opt2) from DENV-3 Consensus__SSopt-pr(D104A)ME(F108S)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgccaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctctccggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1707 - RNA, 2037 nt, synthetic construct
  misc_feature 1..2037: note = derived and/or modified CDS sequence (opt2) from DENV-3 Consensus__SSopt-pr(D104A)ME(R186L,A265T)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgccaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctcccccctcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcaccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1708 - RNA, 2037 nt, synthetic construct
  misc_feature 1..2037: note = derived and/or modified CDS sequence (opt2) from DENV-3 Consensus__SSopt-pr(D104A)ME(F108S,R186L,A265T)
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgccaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctctccggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctcccccctcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcaccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1709 - RNA, 2016 nt, synthetic construct
  misc_feature 1..2016: note = derived and/or modified CDS sequence (opt2) from DENV-3 Consensus__SSopt-prMEdel101-107,(R99P,F108N)
  source 1..2016: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccccggcaacggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggcctga

SEQ ID NO: 1710 - RNA, 2037 nt, synthetic construct
  misc_feature 1..2037: note = derived and/or modified CDS sequence (opt2) from DENV-3 Consensus__SSopt-prMEdelstem_TM-JEV
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1711 - RNA, 2037 nt, synthetic construct
  misc_feature 1..2037: note = derived and/or modified CDS sequence (opt2) from DENV-3 Consensus__SSopt-pr(D104A)MEdelstem_TM,(F108S)-JEV
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgccaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctctccggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1712 - RNA, 2037 nt, synthetic construct
  misc_feature 1..2037: note = derived and/or modified CDS sequence (opt2) from DENV-3 Consensus__SSopt-pr(D104A)MEdelstem_TM,(R186L,A265T)-JEV
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgccaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctcccccctcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcaccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1713 - RNA, 2037 nt, synthetic construct
  misc_feature 1..2037: note = derived and/or modified CDS sequence (opt2) from DENV-3 Consensus__SSopt-pr(D104A)MEdelstem_TM,(F108S,R186L,A265T)- JEV
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgccaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctctccggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctcccccctcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcaccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1714 - RNA, 2037 nt, synthetic construct
  misc_feature 1..2037: note = derived and/or modified CDS sequence (opt2) from DENV-3 Consensus__SSopt-prMEdelstem_TM,(H259N)-JEV
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgaacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1715 - RNA, 2037 nt, synthetic construct
  misc_feature 1..2037: note = derived and/or modified CDS sequence (opt2) from DENV-3 Consensus__SSopt-prMEdelstem_TM,(R186L,A265T)-JEV
  source 1..2037: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctcccccctcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcaccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1716 - RNA, 2016 nt, synthetic construct
  misc_feature 1..2016: note = derived and/or modified CDS sequence (opt2) from DENV-3 Consensus__SSopt-prMEdelstem_TM,del101-107,(R99P,F108N)-JEV
  source 1..2016: mol_type = other RNA
atgaagcgcaagaagacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccccggcaacggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctccaccctcggcaaggccttctccaccaccctcaagggcgcccagcgcctcgccgccctcggcgacaccgcctgggacttcggctccatcggcggcgtcttcaactccatcggccgcgccgtccaccaggtcttcggcggcgccttccgcaccctcttcggcggcatgtcctggatcacccagggcctcatgggcgccctcctcctctggatgggcgtcaacgcccgcgaccgctccatcgccctcgccttcctcgccaccggcggcgtcctcgtcttcctcgccaccaacgtccacgcctga

SEQ ID NO: 1717 - RNA, 3081 nt, synthetic construct
  misc_feature 1..3081: note = derived and/or modified CDS sequence (opt2) from DENV-3 Consensus__SSc-prME-NS1
  source 1..3081: mol_type = other RNA
atgacctccctctgcctcatgatgatcctccccgccgccctcgccttccacctcacctcccgcgacggcgagccccgcatgatcgtcggcaagaacgagcgcggcaagtccctcctcttcaagaccgcctccggcatcaacatgtgcaccctcatcgccatggacctcggcgagatgtgcgacgacaccgtcacctacaagtgcccccacatcaccgaggtcgagcccgaggacatcgactgctggtgcaacctcacctccacctgggtcacctacggcacctgcaaccaggccggcgagcaccgccgcgacaagcgctccgtcgccctcgccccccacgtcggcatgggcctcgacacccgcacccagacctggatgtccgccgagggcgcctggcgccaggtcgagaaggtcgagacctgggccctccgccaccccggcttcaccatcctcgccctcttcctcgcccactacatcggcacctccctcacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctccgtcggcggcgtcctcaactccctcggcaagatggtccaccagatcttcggctccgcctacaccgccctcttctccggcgtctcctgggtcatgaagatcggcatcggcgtcctcctcacctggatcggcctcaactccaagaacacctccatgtccttctcctgcatcgccatcggcatcatcaccctctacctcggcgccgtcgtccaggccgacatgggctgcgtcatcaactggaagggcaaggagctcaagtgcggctccggcatcttcgtcaccaacgaggtccacacctggaccgagcagtacaagttccaggccgactcccccaagcgcctcgccaccgccatcgccggcgcctgggagaacggcgtctgcggcatccgctccaccacccgcatggagaacctcctctggaagcagatcgccaacgagctcaactacatcctctgggagaacaacatcaagctcaccgtcgtcgtcggcgacatcatcggcgtcctcgagcagggcaagcgcaccctcaccccccagcccatggagctcaagtactcctggaagacctggggcaaggccaagatcgtcaccgccgagacccagaactcctccttcatcatcgacggccccaacacccccgagtgcccctccgtctcccgcgcctggaacgtctgggaggtcgaggactacggcttcggcgtcttcaccaccaacatctggctcaagctccgcgaggtctacacccagctctgcgaccaccgcctcatgtccgccgccgtcaaggacgagcgcgccgtccacgccgacatgggctactggatcgagtcccagaagaacggctcctggaagctcgagaaggcctccctcatcgaggtcaagacctgcacctggcccaagtcccacaccctctggtccaacggcgtcctcgagtccgacatgatcatccccaagtccctcgccggccccatctcccagcacaaccaccgccccggctaccacacccagaccgccggcccctggcacctcggcaagctcgagctcgacttcaactactgcgagggcaccaccgtcgtcatcaccgagaactgcggcacccgcggcccctccctccgcaccaccaccgtctccggcaagctcatccacgagtggtgctgccgctcctgcaccctcccccccctccgctacatgggcgaggacggctgctggtacggcatggagatccgccccatctccgagaaggaggagaacatggtcaagtccctcgtctccgcctga

SEQ ID NO: 1718 - RNA, 1824 nt, synthetic construct
  misc_feature 1..1824: note = derived and/or modified CDS sequence (opt2) from DENV-3 Consensus__SSm-EdelTM-linker-ferritin
  source 1..1824: mol_type = other RNA
atgacccagaaggtcgtcatcttcatcctcctcatgctcgtcaccccctccatgaccatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctcctccggcggcgacatcatcaagctcctcaacgagcaggtcaacaaggagatgcagtcctccaacctctacatgtccatgtcctcctggtgctacacccactccctcgacggcgccggcctcttcctcttcgaccacgccgccgaggagtacgagcacgccaagaagctcatcatcttcctcaacgagaacaacgtccccgtccagctcacctccatctccgcccccgagcacaagttcgagggcctcacccagatcttccagaaggcctacgagcacgagcagcacatctccgagtccatcaacaacatcgtcgaccacgccatcaagtccaaggaccacgccaccttcaacttcctccagtggtacgtcgccgagcagcacgaggaggaggtcctcttcaaggacatcctcgacaagatcgagctcatcggcaacgagaaccacggcctctacctcgccgaccagtacgtcaagggcatcgccaagtcccgcaagtcctga

SEQ ID NO: 1719 - RNA, 1821 nt, synthetic construct
  misc_feature 1..1821: note = derived and/or modified CDS sequence (opt2) from DENV-3 Consensus__SStPA-WHbcAg-linker-EdelTM
  source 1..1821: mol_type = other RNA
atggacgccatgaagcgcggcctctgctgcgtcctcctcctctgcggcgccgtcttcgtcgactccgtcaccggcatggacatcgacccctacaaggagttcggctcctcctaccagctcctcaacttcctccccctcgacttcttccccgacctcaacgccctcgtcgacaccgccaccgccctctacgaggaggagctcaccggccgcgagcactgctccccccaccacaccgccatccgccaggccctcgtctgctgggacgagctcaccaagctcatcgcctggatgtcctccaacatcacctccgagcaggtccgcaccatcatcgtcaaccacgtcaacgacacctggggcctcaaggtccgccagtccctctggttccacctctcctgcctcaccttcggccagcacaccgtccaggagttcctcgtctccttcggcgtctggatccgcacccccgccccctaccgcccccccaacgcccccatcctctccaccctccccgagcacaccgtcatctgcggcggcggcggctccggcggcggcggcatgcgctgcgtcggcgtcggcaaccgcgacttcgtcgagggcctctccggcgccacctgggtcgacgtcgtcctcgagcacggcggctgcgtcaccaccatggccaagaacaagcccaccctcgacatcgagctccagaagaccgaggccacccagctcgccaccctccgcaagctctgcatcgagggcaagatcaccaacatcaccaccgactcccgctgccccacccagggcgaggccaccctccccgaggagcaggaccagaactacgtctgcaagcacacctacgtcgaccgcggctggggcaacggctgcggcctcttcggcaagggctccctcgtcacctgcgccaagttccagtgcctcgagcccatcgagggcaaggtcgtccagtacgagaacctcaagtacaccgtcatcatcaccgtccacaccggcgaccagcaccaggtcggcaacgagacccagggcgtcaccgccgagatcaccccccaggcctccaccaccgaggccatcctccccgagtacggcaccctcggcctcgagtgctccccccgcaccggcctcgacttcaacgagatgatcctcctcaccatgaagaacaaggcctggatggtccaccgccagtggttcttcgacctccccctcccctggacctccggcgccaccaccgagacccccacctggaaccgcaaggagctcctcgtcaccttcaagaacgcccacgccaagaagcaggaggtcgtcgtcctcggctcccaggagggcgccatgcacaccgccctcaccggcgccaccgagatccagaactccggcggcacctccatcttcgccggccacctcaagtgccgcctcaagatggacaagctcgagctcaagggcatgtcctacgccatgtgcaccaacaccttcgtcctcaagaaggaggtctccgagacccagcacggcaccatcctcatcaaggtcgagtacaagggcgaggacgtcccctgcaagatccccttctccaccgaggacggccagggcaaggcccacaacggccgcctcatcaccgccaaccccgtcgtcaccaagaaggaggagcccgtcaacatcgaggccgagccccccttcggcgagtccaacatcgtcatcggcatcggcgacaacgccctcaagatcaactggtacaagaagggctcctccatcggcaagatgttcgaggccaccgcccgcggcgcccgccgcatggccatcctcggcgacaccgcctgggacttcggctcctga

SEQ ID NO: 1720 - RNA, 75 nt, synthetic construct
  misc_feature 1..75: note = derived and/or modified CDS sequence (opt3) from Homo sapiens__SigSeq(TPA)/SStPA
  source 1..75: mol_type = other RNA
atggacgccatgaagagaggcctgtgctgtgtgctccttctgtgcggggctgtcttcgttgatagcgtgaccgga

SEQ ID NO: 1721 - RNA, 489 nt, synthetic construct
  misc_feature 1..489: note = derived and/or modified CDS sequence (opt3) from Helicobacter pylori J99__Ferritin
  source 1..489: mol_type = other RNA
gacatcattaagctgctcaacgaacaggtgaataaagagatgcaaagctccaacctttacatgtctatgtcaagttggtgctatacccacagcctggatggcgccgggttgttcttatttgaccatgctgcagaggaatacgagcacgccaagaaactgataatcttcctaaatgaaaacaatgtccccgttcagctcacatccatttctgcgcctgagcataagtttgagggactgactcagatcttccagaaggcttatgaacacgagcaacatatttcggaatcaatcaacaatatagtggatcacgccatcaaaagcaaggaccacgcaacgtttaacttccttcagtggtacgtagccgagcagcatgaggaagaggtgctgtttaaagatattttggacaagatcgaactcattggtaatgagaaccacggcctgtatctggctgatcagtacgtcaaagggatcgcaaagagtagaaaatcc

SEQ ID NO: 1722 - RNA, 450 nt, synthetic construct
  misc_feature 1..450: note = derived and/or modified CDS sequence (opt3) from Woodchuck hepatitis virus__WHbcAg
  source 1..450: mol_type = other RNA
atggacatcgatccctacaaggagttcggcagctcctatcagctgctcaactttcttcctctggacttctttccagatttgaatgccttagtggacaccgctacagcactgtacgaagaggaactaactgggagagagcactgctctccgcatcacacggccattaggcaagcgctcgtctgttgggatgaactgaccaaacttatagcttggatgtcaagtaacatcacaagcgagcaggttcggactattatcgtgaatcatgtaaacgacacctggggactgaaggtgcgccagtccttgtggttccacctctcttgcctgacatttggtcagcataccgtccaagagttcctggtgtcgtttggcgtttggattcgaactcccgccccttatcgtccacccaatgcacctatcctctcaacattaccagaacacaccgtgatatgt

SEQ ID NO: 1723 - RNA, 303 nt, synthetic construct
  misc_feature 1..303: note = derived and/or modified CDS sequence (opt3) from Japanese encephalitis virus__Cterm-JEV/JEV
  source 1..303: mol_type = other RNA
ggcagcaccctggggaaggccttctccacaactctcaaaggagctcagagacttgcagccctgggtgacacggcgtgggattttggctctatcgggggagtgttcaactcaattggcagggctgtccaccaagtttttggtggggccttccggaccttgtttggaggcatgagttggataacacagggcttaatgggggcactgctactctggatgggagtgaatgcccgcgaccgaagcatcgctctggcattccttgccactggtggcgtactggtgtttttggctaccaacgtccatgcc

SEQ ID NO: 1724 - RNA, 15 nt, synthetic construct
  misc_feature 1..15: note = derived and/or modified CDS sequence (opt3) from Artificial__MKRKK
  source 1..15: mol_type = other RNA
atgaagagaaagaaa

SEQ ID NO: 1725 - skipped

SEQ ID NO: 1726 - RNA, 27 nt, synthetic construct
  misc_feature 1..27: note = derived and/or modified CDS sequence (opt3) from Artificial__Linker(G4SG4)
  source 1..27: mol_type = other RNA
ggcgggggaggtagcggcgggggaggc

SEQ ID NO: 1727 - RNA, 51 nt, synthetic construct
  misc_feature 1..51: note = derived and/or modified CDS sequence (opt3) from Foot-and-mouth disease virus__F2A/P2A
  source 1..51: mol_type = other RNA
aacttcgaccttctcaagctggccggcgatgtggagagcaatcccgggcct

SEQ ID NO: 1728 - RNA, 300 nt, synthetic construct
  misc_feature 1..300: note = derived and/or modified CDS sequence (opt3) from DENV-1 CYD23__C
  source 1..300: mol_type = other RNA
atgaacaatcagagaaagaaaaccgccaggcccagcttcaacatgctgaagcgggctcgcaatcgagtgtccacagtctctcaactcgcaaaacgtttttcaaagggccttctgagtgggcagggacctatgaaattggttatggccttcatcgcgtttttaagattcctggctattccaccgactgccggtatactagcaaggtggggcagctttaagaagaacggggccatcaaagtgctccggggattcaagaaagagatttccaatatgctgaacatcatgaatcgcagaaggaag

SEQ ID NO: 1729 - RNA, 342 nt, synthetic construct
  misc_feature 1..342: note = derived and/or modified CDS sequence (opt3) from DENV-1 CYD23__C-SSc
  source 1..342: mol_type = other RNA
atgaacaatcagagaaagaaaaccgccaggcccagcttcaacatgctgaagcgggctcgcaatcgagtgtccacagtctctcaactcgcaaaacgtttttcaaagggccttctgagtgggcagggacctatgaaattggttatggccttcatcgcgtttttaagattcctggctattccaccgactgccggtatactagcaaggtggggcagctttaagaagaacggggccatcaaagtgctccggggattcaagaaagagatttccaatatgctgaacatcatgaatcgcagaaggaagtctgtaacgatgcttctgatgttgatgcccaccgctctcgca

SEQ ID NO: 1730 - RNA, 273 nt, synthetic construct
  misc_feature 1..273: note = derived and/or modified CDS sequence (opt3) from DENV-1 CYD23__pr
  source 1..273: mol_type = other RNA
ttccacctgaccacaagaggcggggagccccatatgatcgtgagcaagcaggaaaggggaaaatccctcctttttaagacttctgccggtgtcaacatgtgcacgctgattgctatggacttgggcgagttatgtgaagataccatgacatacaaatgccctcggataactgaggcagaaccagacgatgttgactgttggtgcaatgccaccgatacatgggtgacctatgggacttgttcacaaacaggagagcaccgccgagacaagcgt

SEQ ID NO: 1731 - RNA, 225 nt, synthetic construct
  misc_feature 1..225: note = derived and/or modified CDS sequence (opt3) from DENV-1 CYD23__M
  source 1..225: mol_type = other RNA
agcgtggccctggctccccacgtcggcctcgggcttgagaccagaacagaaacttggatgtcctctgagggagcatggaagcagatccaaagggttgaaacgtgggccctgcggcatcctggtttcaccgtgattgcgttgtttttagctcacgccataggcacatcaatcactcagaaagggattatcttcattctgctaatgctcgtaaccccaagtatggca

SEQ ID NO: 1732 - RNA, 498 nt, synthetic construct
  misc_feature 1..498: note = derived and/or modified CDS sequence (opt3) from DENV-1 CYD23__prM
  source 1..498: mol_type = other RNA
ttccacctgaccacaagaggcggggagccccatatgatcgtgagcaagcaggaaaggggaaaatccctcctttttaagacttctgccggtgtcaacatgtgcacgctgattgctatggacttgggcgagttatgtgaagataccatgacatacaaatgccctcggataactgaggcagaaccagacgatgttgactgttggtgcaatgccaccgatacatgggtgacctatgggacttgttcacaaacaggagagcaccgccgagacaagcgtagtgtagcgctggctccgcatgtgggcctaggtctcgagaccagaacggaaacttggatgagctccgagggggcctggaaacagatccagagggtcgaaacctgggcactgcggcaccccggattcacagtgattgccctttttctggctcatgcaatcggcacttctattacccagaagggcatcatattcatcttgctcatgctggttacaccttcgatggcc

SEQ ID NO: 1733 - RNA, 1485 nt, synthetic construct
  misc_feature 1..1485: note = derived and/or modified CDS sequence (opt3) from DENV-1 CYD23__E
  source 1..1485: mol_type = other RNA
atgagatgcgtgggcatcgggagcagggacttcgtcgagggactgtccggtgccacctgggttgatgtggtactcgaacacggctcttgtgtgacaactatggctaaggacaaacccacgcttgatattgagctgttgaagaccgaagtcacaaaccctgcagtgttacggaaactgtgcatagaggccaagatctcaaatactaccacagacagtcgctgtccaacccagggggaagcgactctagttgaggagcaagatgctaactttgtgtgccgacgtacattcgtcgacagaggatggggcaatggttgtgggctctttggaaaaggcagcctgattacctgcgccaagttcaagtgtgtgacgaaacttgaaggcaagatcgtacagtacgagaacctgaaatattccgttattgtgactgtccataccggggatcagcaccaggtgggaaatgaatctacagagcatggtactaccgcaacaatcaccccgcaagcccccacgactgagatacagttgacagactacggcgctctcaccctggattgctcgcctaggactgggctggactttaacgaaatggtgctcttaacaatgaaggagaaatcatggctggtccacaagcagtggttccttgatttgccactgccctggaccagcggagcaagtacgtcccaggaaacctggaatcggcaagacctactcgttacatttaagactgcccatgctaaaaagcaggaggtggtagtgctgggctctcaggaaggtgccatgcacaccgcgcttacaggggcaactgagatccagaccagcggaacaaccactattttcgccggccacctgaaatgtcgcttgaagatggataaactcacgctgaagggcatgtcctatgtcatgtgcacagggtcatttaaattagagaaggaagtggctgagacccaacatggaactgttctggtgcagatcaagtacgaaggtaccgacgccccttgtaaaattccattcagtacacaggacgagaagggcgtcacccaaaacgggagactcatcactgcaaatcccatagtgacagataaagaaaagcctgtaaacattgaggctgagccaccgtttggagaaagctatatcgttattggcgccggtgagaaagcgcttaagctgtcttggttcaagaaagggtcctcaatcggcaagatgtttgaagccacggcaaggggagctcggcgcatggccatcttgggcgacaccgcttgggatttcgggagcattggaggtgtgttcacaagtgtcggcaagctagtgcaccagatatttgggactgcctacggagtcctgttctctggcgtgtcctggaccatgaaaatcggtattggggttctcctgacatggcttggcctgaatagccgatcgacttctttgtccatgacctgcatcgcagtgggactcgtaacgctgtatttaggcgtcatggtgcaggcc

SEQ ID NO: 1734 - RNA, 1983 nt, synthetic construct
  misc_feature 1..1983: note = derived and/or modified CDS sequence (opt3) from DENV-1 CYD23__prME
  source 1..1983: mol_type = other RNA
ttccacctgaccacaagaggcggggagccccatatgatcgtgagcaagcaggaaaggggaaaatccctcctttttaagacttctgccggtgtcaacatgtgcacgctgattgctatggacttgggcgagttatgtgaagataccatgacatacaaatgccctcggataactgaggcagaaccagacgatgttgactgttggtgcaatgccaccgatacatgggtgacctatgggacttgttcacaaacaggagagcaccgccgagacaagcgtagtgtagcgctggctccgcatgtgggcctaggtctcgagaccagaacggaaacttggatgagctccgagggggcctggaaacagatccagagggtcgaaacctgggcactgcggcaccccggattcacagtgattgccctttttctggctcatgcaatcggcacttctattacccagaagggcatcatattcatcttgctcatgctggttacaccttcgatggccatgcgctgcgtggggattggatcaagagattttgtcgagggtctgagcggcgctacctgggtggacgtagttctcgagcacgggagttgtgtgacgactatggccaaggataaaccaacattagacatcgaactgcttaagaccgaggtcactaaccccgcggtgttgaggaaactgtgcattgaagcaaagatctccaatacaaccacggattctcggtgtcctacccaaggagaggccactctagtggaggaacaggacgctaacttcgtctgccgccgaacatttgttgatagaggctggggtaatgggtgtggactcttcggcaaaggcagcctgataacctgcgccaagtttaagtgcgtgacaaaacttgaggggaagattgtacagtacgaaaacctgaaatattccgtgatcgtcactgtgcacaccggagaccagcatcaagttggtaatgagtcaacagaacacggcaccactgcaacgattacaccacaggctcccaccactgagatccagttgaccgactacggggccctcacactggattgtagtcctaggaccggattagacttcaacgaaatggtgctgctcactatgaaggagaaaagctggcttgtccataagcagtggtttctggatttgccactaccgtggacatctggcgcgtccacgtcacaagagacctggaatcggcaggacctgctcgtgactttcaaaacagcccacgcaaagaagcaggaagtagttgtgctgggtagccaagagggggctatgcacaccgcccttacaggcgctactgaaatccagaccagtggaacgaccacaatttttgccggccatctgaaatgccgtttgaagatggataaactcactctgaaggggatgtcttatgtcatgtgtaccggatccttcaaattagagaaggaagtggcagagacacagcacggtactgtcctggtgcagataaagtacgagggcaccgacgccccctgcaaaatccctttcagcacgcaagatgaaaagggggttacacagaacggacgcctaattaccgctaatccaatcgtgactgacaaagagaagcccgtaaacatagaagcggagcctccatttggcgagtcgtatattgtcatcggtgcaggggaaaaagccctcaagctgtcttggttcaagaaaggctcctcaatcggaaagatgtttgaggctacagccagaggcgcaaggcggatggccattcttggggataccgcttgggacttcggaagtatcggtggcgtgtttactagcgttgggaaattggtgcatcagattttcggaaccgcctacggcgtcctgttttccggtgtgtcttggacaatgaagatagggatcggcgtactcctgacgtggcttggactgaatagccgatcaaccagtttgtccatgacttgtattgcagtgggcctcgttacactgtacttaggggtcatggtgcaggcg

SEQ ID NO: 1735 - RNA, 2025 nt, synthetic construct
  misc_feature 1..2025: note = derived and/or modified CDS sequence (opt3) from DENV-1 CYD23__SSc-prME
  source 1..2025: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggagttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaggaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggcc

SEQ ID NO: 1736 - RNA, 2325 nt, synthetic construct
  misc_feature 1..2325: note = derived and/or modified CDS sequence (opt3) from DENV-1 CYD23__C-prME
  source 1..2325: mol_type = other RNA
atgaacaatcagagaaagaaaaccgccaggcccagcttcaacatgctgaagcgggctcgcaatcgagtgtccacagtctctcaactcgcaaaacgtttttcaaagggccttctgagtgggcagggacctatgaaattggttatggccttcatcgcgtttttaagattcctggctattccaccgactgccggtatactagcaaggtggggcagctttaagaagaacggggccatcaaagtgctccggggattcaagaaagagatttccaatatgctgaacatcatgaatcgcagaaggaagtctgtaacgatgcttctgatgttgatgcccaccgctctcgcatttcacctgacaactcggggcggtgaacctcatatgattgtgtcgaaacaggagcgcgggaagtcacttctcttcaagaccagcgccggagtcaacatgtgcacattaatcgctatggacctgggcgaactttgtgaggataccatgacttacaaatgcccacgaataacagaagccgagcccgacgatgtggactgttggtgcaatgcgaccgatacgtgggttacttatggcacctgtagtcagacaggggagcacagaagggacaagcggtccgtggcattggcccctcatgtcggactgggtctagaaactcgtaccgagacatggatgtctagcgaaggcgcttggaaacaaatccagcgcgtggagacctgggccctcagacacccagggtttacggtaattgcactgttccttgctcatgccatcggaacttccattacacagaagggcatcatatttattctgttgatgctcgttaccccctcaatggcgatgaggtgcgtgggtatcgggagtcgggatttcgtcgagggactgagcggcgccacttgggtggacgtggtcttagaacacggctcttgtgttacaaccatggcaaaagataagcctacgctggacattgagctccttaaaaccgaagtgacaaacccagctgtactgcgaaagttgtgcatcgaggccaagatctccaatactaccacagattcacgctgtccgactcagggggaagctaccctagtggaggagcaagacgccaactttgtctgcagaaggacattcgtggatcggggatggggtaatggctgtgggctgttcggaaaaggcagcctcattacctgcgcaaagtttaaatgcgttactaagctggaaggtaaaatagtgcagtacgagaaccttaagtatagtgtcatcgtgacggtacacacaggggaccagcatcaggttggcaatgaatctaccgagcacggaactaccgccacaattactccccaagctcctaccacagaaatccagctgacggactacggcgcgttgaccctcgattgttccccacgcactgggctggacttcaacgagatggtgttactgacaatgaaggagaaaagctggctagtccataagcagtggtttctcgatctgccccttccttggacctcgggagcatctacatcccaagaaacttggaacagacaggacttgctggtgaccttcaaaacggcccacgctaagaaacaggaggtcgtggttctcggttcacaggaaggcgccatgcacaccgcactgacaggggccactgagatacaaaccagtggaacaactaccatttttgctggccatcttaagtgcaggctgaagatggataaattgacgctcaagggtatgagctatgtgatgtgtacagggtccttcaaactggaaaaggaggtagccgagacccagcacggcactgtcttagtgcagatcaaatacgaaggaacagacgcaccatgcaagatccccttttctacccaggatgagaagggcgttactcaaaatgggcgtctgattaccgcgaacccgatcgtgacagacaaagaaaagcctgtcaatattgaggctgagcccccattcggagaaagctatatagtgatcggtgccggcgagaaagcactaaagctctcatggtttaaaaaggggagttccattggaaaaatgttcgaagccacggctcggggcgcccgaagaatggcaatcctgggtgataccgcttgggactttgggagcatcggcggagtattcacttctgtgggcaagctggttcatcagatttttgggacagcctacggagtcttgttctcaggcgtgagttggaccatgaagataggtatcggggtgctgctcacatggctgggattaaacagcaggtccacttctctgtcgatgacctgtattgcggtcggccttgttacgttgtacctcggtgtgatggtgcaggcc

SEQ ID NO: 1737 - RNA, 45 nt, synthetic construct
  misc_feature 1..45: note = derived and/or modified CDS sequence (opt3) from DENV-1 CYD23__SSc
  source 1..45: mol_type = other RNA
atgagcgtgaccatgctgctcatgcttatgcccacagccctggct

SEQ ID NO: 1738 - RNA, 57 nt, synthetic construct
  misc_feature 1..57: note = derived and/or modified CDS sequence (opt3) from DENV-1 CYD23__SSopt
  source 1..57: mol_type = other RNA
atgaagagaaagaaaagcgtgaccatgctgctcatgcttatgcccacagccctggct

SEQ ID NO: 1739 - RNA, 57 nt, synthetic construct
  misc_feature 1..57: note = derived and/or modified CDS sequence (opt3) from DENV-1 CYD23__SSm
  source 1..57: mol_type = other RNA
atgacccagaagggcatcattttcatactgctcatgcttgtgacacccagcatggcc

SEQ ID NO: 1740 - RNA, 1488 nt, synthetic construct
  misc_feature 1..1488: note = derived and/or modified CDS sequence (opt3) from DENV-1 CYD23__E
  source 1..1488: mol_type = other RNA
atgagatgcgtgggcatcgggagcagggacttcgtcgagggactgtccggtgccacctgggttgatgtggtactcgaacacggctcttgtgtgacaactatggctaaggacaaacccacgcttgatattgagctgttgaagaccgaagtcacaaaccctgcagtgttacggaaactgtgcatagaggccaagatctcaaatactaccacagacagtcgctgtccaacccagggggaagcgactctagttgaggagcaagatgctaactttgtgtgccgacgtacattcgtcgacagaggatggggcaatggttgtgggctctttggaaaaggcagcctgattacctgcgccaagttcaagtgtgtgacgaaacttgaaggcaagatcgtacagtacgagaacctgaaatattccgttattgtgactgtccataccggggatcagcaccaggtgggaaatgaatctacagagcatggtactaccgcaacaatcaccccgcaagcccccacgactgagatacagttgacagactacggcgctctcaccctggattgctcgcctaggactgggctggactttaacgaaatggtgctcttaacaatgaaggagaaatcatggctggtccacaagcagtggttccttgatttgccactgccctggaccagcggagcaagtacgtcccaggaaacctggaatcggcaagacctactcgttacatttaagactgcccatgctaaaaagcaggaggtggtagtgctgggctctcaggaaggtgccatgcacaccgcgcttacaggggcaactgagatccagaccagcggaacaaccactattttcgccggccacctgaaatgtcgcttgaagatggataaactcacgctgaagggcatgtcctatgtcatgtgcacagggtcatttaaattagagaaggaagtggctgagacccaacatggaactgttctggtgcagatcaagtacgaaggtaccgacgccccttgtaaaattccattcagtacacaggacgagaagggcgtcacccaaaacgggagactcatcactgcaaatcccatagtgacagataaagaaaagcctgtaaacattgaggctgagccaccgtttggagaaagctatatcgttattggcgccggtgagaaagcgcttaagctgtcttggttcaagaaagggtcctcaatcggcaagatgtttgaagccacggcaaggggagctcggcgcatggccatcttgggcgacaccgcttgggatttcgggagcattggaggtgtgttcacaagtgtcggcaagctagtgcaccagatatttgggactgcctacggagtcctgttctctggcgtgtcctggaccatgaaaatcggtattggggttctcctgacatggcttggcctgaatagccgatcgacttctttgtccatgacctgcatcgcagtgggactcgtaacgctgtatttaggcgtcatggtgcaggcctga

SEQ ID NO: 1741 - RNA, 1182 nt, synthetic construct
  misc_feature 1..1182: note = derived and/or modified CDS sequence (opt3) from DENV-1 CYD23__EdelTM-variant (aa1-394)
  source 1..1182: mol_type = other RNA
atgagatgcgtgggcatcgggagcagggacttcgtcgagggactgtccggtgccacctgggttgatgtggtactcgaacacggctcttgtgtgacaactatggctaaggacaaacccacgcttgatattgagctgttgaagaccgaagtcacaaaccctgcagtgttacggaaactgtgcatagaggccaagatctcaaatactaccacagacagtcgctgtccaacccagggggaagcgactctagttgaggagcaagatgctaactttgtgtgccgacgtacattcgtcgacagaggatggggcaatggttgtgggctctttggaaaaggcagcctgattacctgcgccaagttcaagtgtgtgacgaaacttgaaggcaagatcgtacagtacgagaacctgaaatattccgttattgtgactgtccataccggggatcagcaccaggtgggaaatgaatctacagagcatggtactaccgcaacaatcaccccgcaagcccccacgactgagatacagttgacagactacggcgctctcaccctggattgctcgcctaggactgggctggactttaacgaaatggtgctcttaacaatgaaggagaaatcatggctggtccacaagcagtggttccttgatttgccactgccctggaccagcggagcaagtacgtcccaggaaacctggaatcggcaagacctactcgttacatttaagactgcccatgctaaaaagcaggaggtggtagtgctgggctctcaggaaggtgccatgcacaccgcgcttacaggggcaactgagatccagaccagcggaacaaccactattttcgccggccacctgaaatgtcgcttgaagatggataaactcacgctgaagggcatgtcctatgtcatgtgcacagggtcatttaaattagagaaggaagtggctgagacccaacatggaactgttctggtgcagatcaagtacgaaggtaccgacgccccttgtaaaattccattcagtacacaggacgagaagggcgtcacccaaaacgggagactcatcactgcaaatcccatagtgacagataaagaaaagcctgtaaacattgaggctgagccaccgtttggagaaagctatatcgttattggcgccggtgagaaagcgcttaagctgtcttggttcaagaaa

SEQ ID NO: 1742 - RNA, 1275 nt, synthetic construct
  misc_feature 1..1275: note = derived and/or modified CDS sequence (opt3) from DENV-1 CYD23__EdelTM-variant (aa1-424)
  source 1..1275: mol_type = other RNA
atgagatgcgtgggcatcgggagcagggacttcgtcgagggactgtccggtgccacctgggttgatgtggtactcgaacacggctcttgtgtgacaactatggctaaggacaaacccacgcttgatattgagctgttgaagaccgaagtcacaaaccctgcagtgttacggaaactgtgcatagaggccaagatctcaaatactaccacagacagtcgctgtccaacccagggggaagcgactctagttgaggagcaagatgctaactttgtgtgccgacgtacattcgtcgacagaggatggggcaatggttgtgggctctttggaaaaggcagcctgattacctgcgccaagttcaagtgtgtgacgaaacttgaaggcaagatcgtacagtacgagaacctgaaatattccgttattgtgactgtccataccggggatcagcaccaggtgggaaatgaatctacagagcatggtactaccgcaacaatcaccccgcaagcccccacgactgagatacagttgacagactacggcgctctcaccctggattgctcgcctaggactgggctggactttaacgaaatggtgctcttaacaatgaaggagaaatcatggctggtccacaagcagtggttccttgatttgccactgccctggaccagcggagcaagtacgtcccaggaaacctggaatcggcaagacctactcgttacatttaagactgcccatgctaaaaagcaggaggtggtagtgctgggctctcaggaaggtgccatgcacaccgcgcttacaggggcaactgagatccagaccagcggaacaaccactattttcgccggccacctgaaatgtcgcttgaagatggataaactcacgctgaagggcatgtcctatgtcatgtgcacagggtcatttaaattagagaaggaagtggctgagacccaacatggaactgttctggtgcagatcaagtacgaaggtaccgacgccccttgtaaaattccattcagtacacaggacgagaagggcgtcacccaaaacgggagactcatcactgcaaatcccatagtgacagataaagaaaagcctgtaaacattgaggctgagccaccgtttggagaaagctatatcgttattggcgccggtgagaaagcgcttaagctgtcttggttcaagaaagggtcctcaatcggcaagatgtttgaagccacggcaaggggagctcggcgcatggccatcttgggcgacaccgcttgggatttcgggagctga

SEQ ID NO: 1743 - RNA, 1266 nt, synthetic construct
  misc_feature 1..1266: note = derived and/or modified CDS sequence (opt3) from DENV-1 CYD23__EdelTM-variant (aa1-421)
  source 1..1266: mol_type = other RNA
atgagatgcgtgggcatcgggagcagggacttcgtcgagggactgtccggtgccacctgggttgatgtggtactcgaacacggctcttgtgtgacaactatggctaaggacaaacccacgcttgatattgagctgttgaagaccgaagtcacaaaccctgcagtgttacggaaactgtgcatagaggccaagatctcaaatactaccacagacagtcgctgtccaacccagggggaagcgactctagttgaggagcaagatgctaactttgtgtgccgacgtacattcgtcgacagaggatggggcaatggttgtgggctctttggaaaaggcagcctgattacctgcgccaagttcaagtgtgtgacgaaacttgaaggcaagatcgtacagtacgagaacctgaaatattccgttattgtgactgtccataccggggatcagcaccaggtgggaaatgaatctacagagcatggtactaccgcaacaatcaccccgcaagcccccacgactgagatacagttgacagactacggcgctctcaccctggattgctcgcctaggactgggctggactttaacgaaatggtgctcttaacaatgaaggagaaatcatggctggtccacaagcagtggttccttgatttgccactgccctggaccagcggagcaagtacgtcccaggaaacctggaatcggcaagacctactcgttacatttaagactgcccatgctaaaaagcaggaggtggtagtgctgggctctcaggaaggtgccatgcacaccgcgcttacaggggcaactgagatccagaccagcggaacaaccactattttcgccggccacctgaaatgtcgcttgaagatggataaactcacgctgaagggcatgtcctatgtcatgtgcacagggtcatttaaattagagaaggaagtggctgagacccaacatggaactgttctggtgcagatcaagtacgaaggtaccgacgccccttgtaaaattccattcagtacacaggacgagaagggcgtcacccaaaacgggagactcatcactgcaaatcccatagtgacagataaagaaaagcctgtaaacattgaggctgagccaccgtttggagaaagctatatcgttattggcgccggtgagaaagcgcttaagctgtcttggttcaagaaagggtcctcaatcggcaagatgtttgaagccacggcaaggggagctcggcgcatggccatcttgggcgacaccgcttgggattga

SEQ ID NO: 1744 - RNA, 2031 nt, synthetic construct
  misc_feature 1..2031: note = derived and/or modified CDS sequence (opt3) from DENV-1 CYD23__SSc-prME
  source 1..2031: mol_type = other RNA
atgagcgtgaccatgctgctcatgcttatgcccacagccctggctttccacttgactacgagaggcggggagcctcatatgatcgtctccaagcaggaaaggggaaaatctttactgtttaagacctcagcaggagttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaggaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggcctga

SEQ ID NO: 1745 - RNA, 2031 nt, synthetic construct
  misc_feature 1..2031: note = derived and/or modified CDS sequence (opt3) from DENV-1 CYD23__SSc-prME(F108S)
  source 1..2031: mol_type = other RNA
atgagcgtgaccatgctgctcatgcttatgcccacagccctggctttccacttgactacgagaggcggggagcctcatatgatcgtctccaagcaggaaaggggaaaatctttactgtttaagacctcagccggtgttaacatgtgcacactaattgcaatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaggaacaggacgcaaacttcgtttgccgccgaacatttgtggatagaggctggggtaatgggtgtggattgtccggcaaaggctcactcataacttgcgctaagttcaagtgcgtaaccaaactggaggggaagattgtgcagtacgaaaacttaaaatatagtgtcatcgtgacagttcacaccggagaccagcatcaagtgggtaatgagagcactgaacacggcacgacagccaccattactccccaggcgcctaccacagagatccagctgaccgactacggggccctcactcttgattgttctccaaggacaggactggactttaacgaaatggtcttgctaacgatgaaggagaaatcctggctggtgcataagcagtggttcctcgatctgccgcttccctggacctcaggcgcaagcacaagtcaagagacttggaatcggcaggacctgttggtaacctttaaaacagctcacgccaagaagcaggaagttgtggtcctcggttctcaagagggggctatgcacactgccctgaccggcgcaacggaaatccagacctccggaacaactaccattttcgccggccatttaaaatgccgtctgaagatggataaactaacactcaaggggatgagctatgtgatgtgtactggatcgtttaaactggagaaggaagtcgctgagacccagcacggtacggtgcttgttcagataaagtacgagggcacagacgcgccttgcaaaatcccattctctacccaagatgaaaagggggtgactcagaacggacgcttgattacagcaaatcccatcgtaaccgacaaagagaagcctgtcaacatagaagccgagccacccttcggcgagtcctatattgtgatcggtgctggggaaaaagccctgaagctctcatggtttaagaaaggcagtagcatcggaaagatgttcgaggcaactgccagaggcgctaggcggatggccattctgggggataccgcatgggactttggatccatcggtggcgttttcacatctgtggggaaacttgtccatcagatttttggaacggcgtacggcgtgctgttcagcggtgtatcatggaccatgaagatagggatcggcgtgttgctcacttggctgggattaaatagtcgatccacaagcctgtctatgacctgtattgctgttggcctagtcacactctacctgggggtgatggtgcaggcctga

SEQ ID NO: 1746 - RNA, 2031 nt, synthetic construct
  misc_feature 1..2031: note = derived and/or modified CDS sequence (opt3) from DENV-1 CYD23__SSc-prMEdelstem_TM-JEV
  source 1..2031: mol_type = other RNA
atgagcgtgaccatgctgctcatgcttatgcccacagccctggctttccacttgactacgagaggcggggagcctcatatgatcgtctccaagcaggaaaggggaaaatctttactgtttaagacctcagcaggagttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaggaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaactctgggaaaggcatttagtaccacacttaaaggcgcccagagactggctgccttgggggatacggcatgggacttcggaagcatcggtggcgtttttaattccattgggagggcggtgcatcaggtcttcggaggcgcttttcggaccctcttcggtgggatgtcttggatcactcaaggcctgatgggagccttactgctatggatgggcgtgaacgcacgagatcgcagcattgccctcgcttttctggccacagggggagtacttgtgttcttggcaaccaatgttcacgcttga

SEQ ID NO: 1747 - RNA, 2379 nt, synthetic construct
  misc_feature 1..2379: note = derived and/or modified CDS sequence (opt3) from DENV-1 CYD23__C-P2A-SSc-prME
  source 1..2379: mol_type = other RNA
atgaacaatcagagaaagaaaaccgccaggcccagcttcaacatgctgaagcgggctcgcaatcgagtgtccacagtctctcaactcgcaaaacgtttttcaaagggccttctgagtgggcagggacctatgaaattggttatggccttcatcgcgtttttaagattcctggctattccaccgactgccggtatactagcaaggtggggcagctttaagaagaacggggccatcaaagtgctccggggattcaagaaagagatttccaatatgctgaacatcatgaatcgcagaaggaagaactttgaccttctgaaattggctggcgatgtagaatctaatcccggtccttcggtgacgatgctcctgatgctgatgccaaccgcactcgccttccacttaacaactcgcgggggagagccccatatgattgtctcaaagcaggaacggggcaagagcctgctttttaaaaccagtgctggcgtgaacatgtgcacattgatcgccatggacctgggggagctatgtgaagataccatgacttacaagtgccctcgaataacagaggcggagccagacgatgttgactgttggtgcaatgcaaccgatacgtgggtgacttatggaacctgttcccagacaggtgaacacagaagggacaaacggtctgtcgccctcgctccccatgtgggcctggggcttgagactcgtaccgaaacatggatgagctccgagggagcctggaagcaaatccagcgcgtagagacctgggcactgagacaccctggcttcacggttattgctttgtttctcgcccatgcgatcggtacttcaattacacagaaagggatcatattcattctgttaatgctggtgaccccaagtatggccatgaggtgcgtcggaatcggcagccgggattttgtggaaggcctctctggggcaacttgggtggacgtcgttcttgagcacggatcctgtgtgacaaccatggctaaggataaaccgacgctggacattgaattgctaaagaccgaggtaacaaaccccgccgtgctgcgaaagctctgcatcgaagctaaaatctcaaatactaccacagatagccgctgtcctactcagggtgaggccaccctggtcgaggaacaagacgcaaacttcgtgtgcagaaggacattcgttgaccggggctgggggaatggatgtggcctttttggtaaggggagtctgttgacctgcgccaaattcaagtgcgtgactaaactcgagggcaagattgtccagtacgaaaacctgaagtattctgtgatagtaacggttcacacaggagatcagcatcaggtgggcaacgagtccaccgaacacgggactaccgctacaatcaccccacaagcgcccactacagagattcagttaacggactacggagcactgaccctagattgtagccctcgcactggtctcgactttaatgagatggtcctgcttacaatgaaagaaaagtcgtggttggtgcataaacagtggttcctggatctcccactgccctggacctctggcgcctccacatcacaagagacttggaacagacaggaccttctggtcacctttaagacggctcacgccaaaaagcaggaagtggttgtgttggggagtcaggagggagcaatgcacaccgccctcacaggcgctactgaaatccaaaccagcggtacaactaccatattcgccgggcatctgaagtgcaggttaaaaatggataagctgacgctaaaaggcatgtcctatgtaatgtgtacaggatcttttaagctcgagaaagaggtcgcagaaacccagcacggcactgtgctggttcagattaagtacgaggggacagacgcgccgtgcaagatccctttcagcacccaggatgaaaaaggagtgactcaaaatggtcgtcttatcaccgctaaccccattgtcacagacaaggagaaaccagtgaatatcgaggccgaacctccctttggcgagtcatatattgtaataggggcaggagaaaaggccttgaaactgagttggttcaagaaaggctccagcatcggtaagatgtttgaggctacggcccgaggggcacggagaatggctattctcggcgataccgcctgggacttcggatctatcggcggggtgtttacttcagttggaaagctggtccatcagatcttcggcacagcgtacggtgtgttattcagtggggtgagctggaccatgaaaattggaataggcgtcctgcttacatggttgggtctcaactccaggtctacttcgctgagcatgacctgtatcgccgttggcctagtgacgctgtacctcggggtgatggtacaggcttga

SEQ ID NO: 1748 - RNA, 2043 nt, synthetic construct
  misc_feature 1..2043: note = derived and/or modified CDS sequence (opt3) from DENV-1 CYD23__SSopt-prME(F108S)
  source 1..2043: mol_type = other RNA
atgaagagaaagaaaagcgtgaccatgctgctcatgcttatgcccacagccctggctttccacttgactacgaggggcggggagcctcatatgatcgtctccaagcaggaacggggaaagtctttactgtttaaaacctcagccggtgttaacatgtgcacactaattgcaatggacctcggcgagctgtgtgaagatactatgacctacaagtgcccacgcataacagaggcggaaccggacgatgtggactgttggtgcaatgctaccgatacttgggtaacatatgggacctgtagtcaaacgggagagcaccgacgtgacaagagaagcgtggcccttgcaccccatgtcggcctgggtttggagactaggaccgaaacatggatgtcctctgagggggcctggaaacagatccagcgggtggaaacttgggctctccgccaccctggattcaccgttattgcactgtttctggcccatgctatcggcacatcgattacccagaagggcatcatattcatcctcttaatgctggtgacgccatcaatggccatgagatgcgtcgggattggaagcagggattttgtggagggtcttagtggcgcgacttgggtagacgttgtgttggagcacgggtcctgtgtcacaaccatggcaaaagataagcccactctggacatcgaactactcaaaacagaggtgaccaaccctgccgtgctgcggaaactttgcattgaagctaagatctctaatacgaccacagatagccgctgtccaactcaaggagaggccaccctggtcgaggaacaggacgcaaacttcgtttgccgaagaacatttgtggataggggctggggtaatgggtgtggattgtccggcaagggctcactcataacttgcgctaagttcaaatgcgtaaccaagctggaggggaaaattgtgcagtacgaaaacttaaagtatagtgtcatcgtgacagttcacaccggagaccagcatcaagtgggtaatgagagcactgaacacggcacgacagccaccattactccccaggcgcctaccacagagatccagctgaccgactacggggccctcactcttgattgttctccacggacaggactggactttaacgaaatggtcttgctaacgatgaaagagaagtcctggctggtgcataagcagtggttcctcgatctgccgcttccctggacctcaggcgcaagcacaagtcaagagacttggaatcgtcaggacctgttggtaacctttaaaacagctcacgccaagaaacaggaagttgtggtcctcggttctcaagagggggctatgcacactgccctgaccggcgcaacggaaatccagacctccggaacaactaccattttcgccggccatttaaagtgccgcctgaaaatggataagctaacactcaaggggatgagctatgtgatgtgtactggatcgtttaaactggagaaggaagtcgctgagacccagcacggtacggtgcttgttcagataaaatacgagggcacagacgcgccttgcaagatcccattctctacccaagatgaaaaaggggtgactcagaacggaagattgattacagcaaatcccatcgtaaccgacaaggagaagcctgtcaacatagaagccgagccacccttcggcgagtcctatattgtgatcggtgctggggaaaaagccctgaagctctcatggtttaaaaagggcagtagcatcggaaaaatgttcgaggcaactgccaggggcgctcggcgaatggccattctgggggataccgcatgggactttggatccatcggtggcgttttcacatctgtggggaaacttgtccatcagatttttggaacggcgtacggcgtgctgttcagcggtgtatcatggaccatgaagatagggatcggcgtgttgctcacttggctgggattaaatagtcgctccacaagcctgtctatgacctgtattgctgttggcctagtcacactctacctgggggtgatggtgcaggcctga

SEQ ID NO: 1749 - RNA, 2043 nt, synthetic construct
  misc_feature 1..2043: note = derived and/or modified CDS sequence (opt3) from DENV-1 CYD23__SSopt-prME(F96H)
  source 1..2043: mol_type = other RNA
atgaagagaaagaaaagcgtgaccatgctgctcatgcttatgcccacagccctggctttccacttgactacgaggggcggggagcctcatatgatcgtctccaagcaggaacggggaaagtctttactgtttaaaacctcagcaggagttaacatgtgcacactaattgccatggacctcggcgagctgtgtgaagatactatgacctacaagtgcccacgcataacagaggcggaaccggacgatgtggactgttggtgcaatgctaccgatacttgggtaacatatgggacctgtagtcaaacgggagagcaccgacgtgacaagagaagcgtggcccttgcaccccatgtcggcctgggtttggagactaggaccgaaacatggatgtcctctgagggggcctggaaacagatccagcgggtggaaacttgggctctccgccaccctggattcaccgttattgcactgtttctggcccatgctatcggcacatcgattacccagaagggcatcatattcatcctcttaatgctggtgacgccatcaatggccatgagatgcgtcgggattggaagcagggattttgtggagggtcttagtggcgcgacttgggtagacgttgtgttggagcacgggtcctgtgtcacaaccatggcaaaagataagcccactctggacatcgaactactcaaaacagaggtgaccaaccctgccgtgctgcggaaactttgcattgaagctaagatctctaatacgaccacagatagccgctgtccaactcaaggagaggccaccctggtcgaggaacaggacgcaaacttcgtttgccgaagaacacacgtggataggggctggggtaatgggtgtggattgtttggcaagggctccctcataacttgcgctaagttcaaatgcgtaaccaagctggaggggaaaattgtgcagtacgaaaacttaaagtattcagtcatcgtgacagttcataccggagaccagcaccaagtgggtaatgagagtactgaacatggcacgacagccaccattactccccaggcgcctaccacagagatccagctgaccgactacggggccctcactcttgattgtagcccacggacaggactggactttaacgaaatggtcttgctaacgatgaaagagaagtcttggctggtgcacaagcagtggttcctcgatctgccgcttccctggacctccggcgcatcaactagccaagagacatggaatcgtcaggacctgttggtaacctttaaaacagctcacgccaagaaacaggaagttgtggtcctcggtagtcaagagggggctatgcatactgccctgaccggcgcaacggaaatccagacctctggaacaactaccattttcgccggccacttaaagtgccgcctgaaaatggataagctaacactcaaggggatgtcctatgtgatgtgtactggtagctttaaactggagaaggaagtcgctgagacccagcatggtacggtgcttgttcagataaaatacgagggcacagacgcgccttgcaagatcccattctcgacccaagatgaaaaaggggtgactcagaacggaagattgattacagcaaatcccatcgtaaccgacaaggagaagcctgtcaacatagaagccgagccacccttcggcgagtcttatattgtgatcggtgctggggaaaaagccctgaagctctcctggtttaaaaagggctcaagtatcggaaaaatgttcgaggcaactgccaggggcgctcggcgaatggccattctgggggataccgcatgggactttggaagcatcggtggcgttttcacatccgtggggaaacttgtccaccagatttttggaacggcgtacggcgtgctgttctctggtgtaagctggaccatgaagatagggatcggcgtgttgctcacttggctgggattaaattcacgcagtacatccctgagcatgacctgtattgctgttggcctagtcacactctacctgggggtgatggtgcaggcctga

SEQ ID NO: 1750 - RNA, 2043 nt, synthetic construct
  misc_feature 1..2043: note = derived and/or modified CDS sequence (opt3) from DENV-1 CYD23__SSopt-prME(S186F)
  source 1..2043: mol_type = other RNA
atgaagagaaagaaaagcgtgaccatgctgctcatgcttatgcccacagccctggctttccacttgactacgaggggcggggagcctcatatgatcgtctccaagcaggaacggggaaagtctttactgtttaaaacctcagccggtgttaacatgtgcacactaattgcaatggacctcggcgagctgtgtgaagatactatgacctacaagtgcccacgcataacagaggcggaaccggacgatgtggactgttggtgcaatgctaccgatacttgggtaacatatgggacctgtagtcaaacgggagagcaccgacgtgacaagagaagcgtggcccttgcaccccatgtcggcctgggtttggagactaggaccgaaacatggatgtcctctgagggggcctggaaacagatccagcgggtggaaacttgggctctccgccaccctggattcaccgttattgcactgtttctggcccatgctatcggcacatcgattacccagaagggcatcatattcatcctcttaatgctggtgacgccatcaatggccatgagatgcgtcgggattggaagcagggattttgtggagggtcttagtggcgcgacttgggtagacgttgtgttggagcacgggtcctgtgtcacaaccatggcaaaagataagcccactctggacatcgaactactcaaaacagaggtgaccaaccctgccgtgctgcggaaactttgcattgaagctaagatctctaatacgaccacagatagccgctgtccaactcaaggagaggccaccctggtcgaggagcaggacgcaaacttcgtttgccgaagaacatttgtggataggggctggggtaatgggtgtggattgttcggcaagggctccctcataacttgcgctaagtttaaatgcgtaaccaagctggaggggaaaattgtgcagtacgaaaacttaaagtattcagtcatcgtgacagttcacaccggagaccagcatcaagtgggtaatgagagtactgaacacggcacgacagccaccattactccccaggcgcctaccacagagatccagctgaccgactacggggccctcactcttgattgtttcccacggacaggactggactttaacgaaatggtcttgctaacgatgaaagaaaagagctggctggtgcataagcagtggttcctcgatctgccgcttccctggacctctggcgcatccacttcacaagagacatggaatcgtcaggacctgttggtaacctttaaaacagctcacgccaagaaacaggaagttgtggtcctcggtagccaagagggggctatgcacactgccctgaccggcgcaacggaaatccagaccagtggaacaactaccattttcgccggccatttaaagtgccgcctgaaaatggataagctaacactcaaggggatgtcttatgtgatgtgtactggatccttcaaactggagaaggaagtcgctgagacccagcacggtacggtgcttgttcagataaaatacgagggcacagacgcgccttgcaagatcccatttagcacccaagatgaaaaaggggtgactcagaacggaagattgattacagcaaatcccatcgtaaccgacaaggagaagcctgtcaacatagaagccgagccacccttcggcgagtcgtatattgtgatcggtgctggggaaaaagccctgaagctctcttggtttaaaaagggctcctcaatcggaaaaatgttcgaggcaactgccaggggcgctcggcgaatggccattctgggggataccgcatgggactttggaagtatcggtggcgttttcacaagcgtggggaaacttgtccatcagatttttggaacggcgtacggcgtgctgttctccggtgtatcttggaccatgaagatagggatcggcgtgttgctcacttggctgggattaaatagccgctcaacaagtctgtccatgacctgtattgctgttggcctagtcacactctacctgggggtgatggtgcaggcctga

SEQ ID NO: 1751 - RNA, 2043 nt, synthetic construct
  misc_feature 1..2043: note = derived and/or modified CDS sequence (opt3) from DENV-1 CYD23__SSopt-prME(R188L)
  source 1..2043: mol_type = other RNA
atgaagaggaaaaagagcgtgaccatgctgctcatgcttatgcccacagccctggctttccacttgactacgagaggcggggagcctcatatgatcgtctccaaacaggaacggggaaagtctttactgtttaaaacctcagcaggagttaacatgtgcacactaattgccatggacctcggcgagctgtgtgaagatactatgacctacaagtgcccacgcataacagaggcggaaccggacgatgtggactgttggtgcaatgctaccgatacttgggtaacatatgggacctgtagtcaaacgggagagcaccgacgtgacaagagaagcgtggcccttgcaccccatgtcggcctgggtttggagactaggaccgaaacatggatgtcctctgagggggcctggaaacagatccagcgggtggaaacttgggctctccgccaccctggattcaccgttattgcactgtttctggcccatgctatcggcacatcgattacccagaagggcatcatattcatcctcttaatgctggtgacgccatcaatggccatgagatgcgtcgggattggaagcagggattttgtggagggtcttagtggcgcgacttgggtagacgttgtgttggagcacgggtcctgtgtcacaaccatggcaaaagataagcccactctggacatcgaactactcaaaacagaggtgaccaaccctgccgtgctgcggaagctgtgcattgaagctaagatctctaatacgaccacagatagccgctgtccaactcaaggagaggccaccctggtcgaggaacaggacgcaaacttcgtttgccgaagaacatttgtggataggggctggggtaatgggtgtggattgttcggcaaaggctccctcataacttgcgctaagtttaaatgcgtaaccaagctggaggggaaaattgtgcagtacgaaaacttaaagtattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccactgacaggattggacttcaacgaaatggtcctactgacgatgaaagagaagtcttggctcgtgcataagcagtggtttctggatcttccgctgccctggacctccggcgcatcaactagccaagagacatggaatcggcaggacttgctcgtaaccttcaaaacagctcacgccaagaaacaggaagttgtggtcctgggtagtcaagagggggctatgcacactgccttaaccggcgcaacggaaatccagacctctggaacaactaccatttttgccggccatctgaagtgccgtctaaaaatggataagctcacactgaaggggatgtcctatgtgatgtgtactggtagcttcaaacttgagaaggaagtcgctgagacccagcacggtacggtgttggttcagataaaatacgagggcacagacgcgccttgcaagatcccattctcgacccaagatgaaaaaggggtgactcagaacggacgcctgattacagcaaatcccatcgtaaccgacaaggagaagcctgtcaacatagaagccgagccaccctttggcgagtcttatattgtgatcggtgctggggaaaaagccctcaagctgtcctggttcaaaaagggctcaagtatcggaaaaatgtttgaggcaactgccagaggcgctaggcggatggccattcttggggataccgcatgggacttcggaagcatcggtggcgtttttacatccgtggggaagctggtccatcagattttcggaacggcgtacggcgtgttgttttctggtgtaagctggaccatgaagatagggatcggcgtgctcctgacttggttaggacttaattcacgaagtacatccctaagcatgacctgtattgctgttggcctcgtcacactgtaccttggggtgatggtgcaggcctga

SEQ ID NO: 1752 - RNA, 2043 nt, synthetic construct
  misc_feature 1..2043: note = derived and/or modified CDS sequence (opt3) from DENV-1 CYD23__SSopt-pr(D104A)MEdelstem_TM,(F108S)-JEV
  source 1..2043: mol_type = other RNA
atgaagaggaaaaagagcgtgaccatgctgctcatgcttatgcccacagccctggctttccacttgactacgagaggcggggagcctcatatgatcgtctccaaacaggaacggggaaagtctttactgtttaaaacctcagccggtgttaacatgtgcacactaattgccatggacctcggcgagctgtgtgaagatactatgacctacaagtgcccacgcataacagaggcggaaccggacgatgtggactgttggtgcaatgctaccgatacttgggtaacatatgggacctgtagtcaaacgggagagcaccgacgtgccaagagaagcgtggcacttgcaccccatgtcggcctgggtttggagactaggaccgaaacatggatgtcctctgagggggcttggaaacagatccagcgggtggaaacttgggcactccgccaccctggattcaccgttattgccctgtttctggctcatgccatcggcacatcgattacccagaagggcatcatattcatcctcttaatgctggtgacgccatcaatggcgatgagatgcgtcgggattggaagcagggactttgtggagggtcttagtggcgcaacttgggtagatgttgtgttggagcacgggtcctgtgtcacaaccatggccaaagacaagcccactctggatatcgaactactcaaaacagaggtgaccaaccctgctgtgctgcggaaactttgcattgaagccaagatctctaatacgaccacagacagccgctgtccaactcaaggagaggcaaccctggtcgaggaacaggatgctaacttcgtttgccgaagaacatttgtggacaggggctggggtaatgggtgtggattgtccggcaagggctcactcataacttgcgccaagttcaaatgcgtaaccaagctggaggggaaaattgtgcagtacgaaaacttaaagtatagtgtcatcgtgacagttcacaccggagatcagcatcaagtgggtaatgagagcactgaacacggcacgacagcgaccattactccccaggcccctaccacagagatccagctgaccgactacggggcactcactcttgactgttctccacggacaggactggattttaacgaaatggtcttgctaacgatgaaagagaagtcctggctggtgcataagcagtggttcctcgacctgccgcttccctggacctcaggcgctagcacaagtcaagagacttggaatcgtcaggatctgttggtaacctttaaaacagcccacgctaagaaacaggaagttgtggtcctcggttctcaagagggggccatgcacactgcactgaccggcgccacggaaatccagacctccggaacaactaccattttcgctggccatttaaagtgccgcctgaaaatggacaagctaacactcaaggggatgagctatgtgatgtgtactggatcgtttaaactggagaaggaagtcgcggagacccagcacggtacggtgcttgttcagataaaatacgagggcacagatgcaccttgcaagatcccattctctacccaagacgaaaaaggggtgactcagaacggaagattgattacagccaatcccatcgtaaccgataaggagaagcctgtcaacatagaagctgagccacccttcggcgagtcctatattgtgatcggtgccggggaaaaagcactgaagctctcatggtttaaaaagggcagtactctgggaaaagccttcagcaccacacttaagggcgctcagaggctggccgcattgggggacacggcgtgggattttggatccatcggtggcgttttcaattctattgggcgggctgtgcatcaggtctttggaggcgccttccgaaccctctttggtgggatgagctggatcactcaaggcctgatgggagcattactgctatggatgggcgtgaacgcccgcgacagatcaattgctctcgccttcctggcaacagggggagtacttgtgtttttggctaccaatgttcacgcctga

SEQ ID NO: 1753 - RNA, 2043 nt, synthetic construct
  misc_feature 1..2043: note = derived and/or modified CDS sequence (opt3) from DENV-1 CYD23__SSopt-prMEdelstem_TM,(H261N)-JEV
  source 1..2043: mol_type = other RNA
atgaagaggaaaaagagcgtgaccatgctgctcatgcttatgcccacagccctggctttccacttgactacgagaggcggggagcctcatatgatcgtctccaaacaggaacggggaaagtctttactgtttaaaacctcagcaggagttaacatgtgcacactaattgccatggacctcggcgagctgtgtgaagatactatgacctacaagtgcccacgcataacagaggcggaaccggacgatgtggactgttggtgcaatgctaccgatacttgggtaacatatgggacctgtagtcaaacgggagagcaccgacgtgacaagagaagcgtggcccttgcaccccatgtcggcctgggtttggagactaggaccgaaacatggatgtcctctgagggggcctggaaacagatccagcgggtggaaacttgggctctccgccaccctggattcaccgttattgcactgtttctggcccatgctatcggcacatcgattacccagaagggcatcatattcatcctcttaatgctggtgacgccatcaatggccatgagatgcgtcgggattggaagcagggattttgtggagggtcttagtggcgcgacttgggtagacgttgtgttggagcacgggtcctgtgtcacaaccatggcaaaagataagcccactctggacatcgaactactcaaaacagaggtgaccaaccctgccgtgctgcggaaactttgcattgaagctaagatctctaatacgaccacagatagccgctgtccaactcaaggagaggccaccctggtcgaggaacaggacgcaaacttcgtttgccgaagaacatttgtggataggggctggggtaatgggtgtggattgttcggcaagggctccctcataacttgcgctaagtttaaatgcgtaaccaagctggaggggaaaattgtgcagtacgaaaacttaaagtattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccacggacaggactggacttcaacgaaatggtcttgctaacgatgaaagagaagtcttggctggtgcataagcagtggtttctcgatctgccgcttccctggacctccggcgcatcaactagccaagagacatggaatcgtcaggacctgttggtaaccttcaaaacagctcacgccaagaaacaggaagttgtggtcctcggtagtcaagagggggctatgaacactgccctgaccggcgcaacggaaatccagacctctggaacaactaccatttttgccggccacttaaagtgccgcctgaaaatggataagctaacactcaaggggatgtcctatgtgatgtgtactggtagcttcaaactggagaaggaagtcgctgagacccagcatggtacggtgcttgttcagataaaatacgagggcacagacgcgccttgcaagatcccattctcgacccaagatgaaaaaggggtgactcagaatggaagattgattacagcaaaccccatcgtaaccgacaaggagaagcctgtcaatatagaagccgagccaccctttggcgagtcttatattgtgatcggtgctggggaaaaagccctgaagctctcctggttcaaaaagggctcaactctgggaaaagcatttagtaccacacttaagggcgcccagaggctggctgccttgggggatacggcatgggacttcggaagcatcggtggcgtttttaactccattgggcgggcggtgcaccaggtcttcggaggcgcttttcgaaccctcttcggtgggatgtcttggatcactcaaggcctgatgggagccttactgctatggatgggcgtgaatgcacgcgatagaagcattgccctcgcttttctggccacagggggagtacttgtgttcttggcaaccaacgttcatgcttga

SEQ ID NO: 1754 - RNA, 2043 nt, synthetic construct
  misc_feature 1..2043: note = derived and/or modified CDS sequence (opt3) from DENV-1 CYD23__SSopt-prMEdelstem_TM,(R188L,A267T)-JEV
  source 1..2043: mol_type = other RNA
atgaagaggaaaaagagcgtgaccatgctgctcatgcttatgcccacagccctggctttccacttgactacgagaggcggggagcctcatatgatcgtctccaaacaggaacggggaaagtctttactgtttaaaacctcagcaggagttaacatgtgcacactaattgccatggacctcggcgagctgtgtgaagatactatgacctacaagtgcccacgcataacagaggcggaaccggacgatgtggactgttggtgcaatgctaccgatacttgggtaacatatgggacctgtagtcaaacgggagagcaccgacgtgacaagagaagcgtggcccttgcaccccatgtcggcctgggtttggagactaggaccgaaacatggatgtcctctgagggggcctggaaacagatccagcgggtggaaacttgggctctccgccaccctggattcaccgttattgcactgtttctggcccatgctatcggcacatcgattacccagaagggcatcatattcatcctcttaatgctggtgacgccatcaatggccatgagatgcgtcgggattggaagcagggattttgtggagggtcttagtggcgcgacttgggtagacgttgtgttggagcacgggtcctgtgtcacaaccatggcaaaagataagcccactctggacatcgaactactcaaaacagaggtgaccaaccctgccgtgctgcggaaactttgcattgaagctaagatctctaatacgaccacagatagccgctgtccaactcaaggagaggccaccctggtcgaggaacaggacgcaaacttcgtttgccgaagaacatttgtggataggggctggggtaatgggtgtggattgttcggcaagggctccctcataacttgcgctaagtttaaatgcgtaaccaagctggaggggaaaattgtgcagtacgaaaacttaaagtattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccactgacaggattggacttcaacgaaatggtcctactgacgatgaaagagaagtcttggctcgtgcataagcagtggtttctggatcttccgctgccctggacctccggcgcatcaactagccaagagacatggaatcggcaggacttgctcgtaaccttcaaaacagctcacgccaagaaacaggaagttgtggtcctgggtagtcaagagggggctatgcacactgccttaaccggcacgaccgaaatccagacatctggaactaccacaatttttgcaggccatctgaagtgccgtctaaaaatggataagctcactctgaaggggatgtcctatgtgatgtgtaccggtagcttcaaacttgagaaggaagtcgccgagacgcagcacggtacagtgttggttcagataaaatacgagggcaccgacgctccttgcaagatcccattctcgactcaagatgaaaaaggggtgacacagaacggacgcctgattaccgcgaatcccatcgtaactgacaaggagaagcctgtcaacatagaagcagagccaccctttggcgagtcttatattgtgatcggtgccggggaaaaagctctcaagctgtcctggttcaaaaagggctcaacccttggaaaagcctttagtacaacgctgaagggcgcacagagattggccgctctcggggataccgcctgggacttcggaagcatcggtggcgtttttaattccattgggagggcagtgcatcaggtcttcggaggcgcgtttcggactctgttcggtgggatgtcttggatcacacaaggcttaatgggagctctgctactctggatgggcgtgaacgcccgagatcgcagcattgcactggcctttcttgctaccgggggagtattggtgttcctggccacaaatgttcacgcatga

SEQ ID NO: 1755 - RNA, 300 nt, synthetic construct
  misc_feature 1..300: note = derived and/or modified CDS sequence (opt3) from DENV-2 CYD2-T__C
  source 1..300: mol_type = other RNA
atgaacaatcagagaaagaaagccaagaacacccccttcaatatgctgaaaagggagcggaaccgcgtgagcacagtccaacagctcactaagcgattttcccttggcatgctgcaggggcgtggacctttgaaattattcatggctctggttgcatttctaagattcctcacgatcccaccgaccgccggtattctgaagaggtggggcacaataaagaaatctaaggcgatcaatgtgcttcgggggtttcgcaaagaaattggaagaatgctgaacatcttgaataggcggcgccga

SEQ ID NO: 1756 - RNA, 342 nt, synthetic construct
  misc_feature 1..342: note = derived and/or modified CDS sequence (opt3) from DENV-2 CYD2-T__C-SSc
  source 1..342: mol_type = other RNA
atgaacaatcagagaaagaaagccaagaacacccccttcaatatgctgaaaagggagcggaaccgcgtgagcacagtccaacagctcactaagcgattttcccttggcatgctgcaggggcgtggacctttgaaattattcatggctctggttgcatttctaagattcctcacgatcccaccgaccgccggtattctgaagaggtggggcacaataaagaaatctaaggcgatcaatgtgcttcgggggtttcgcaaagaaattggaagaatgctgaacatcttgaataggcggcgccgatcagctggcatgattatcatgctcatacccactgtaatggcc

SEQ ID NO: 1757 - RNA, 273 nt, synthetic construct
  misc_feature 1..273: note = derived and/or modified CDS sequence (opt3) from DENV-2 CYD2-T__pr
  source 1..273: mol_type = other RNA
ttccacctgaccacaagaaacggcgagccccatatgatcgtgagcaggcaggaaaaggggaaatccctcctttttaagactgaggacggagtcaatatgtgcacgctgatggccatggatttgggtgaattatgtgaggacaccattacatacaaatgccctctgctacggcaaaacgaaccagaggatatagactgttggtgcaattctacttcaacctgggttacatatggcacctgtactacaatgggggagcaccgccgagaaaagcgt

SEQ ID NO: 1758 - RNA, 225 nt, synthetic construct
  misc_feature 1..225: note = derived and/or modified CDS sequence (opt3) from DENV-2 CYD2-T__M
  source 1..225: mol_type = other RNA
agcgtggccctggtcccccacgttggcatggggctcgagaccagaacagaaacttggatgtcctctgagggagcttggaagcatgtgcagaggatcgaaacgtggattcttcggcaccctggtttcaccatgatggcagccatactggcgtacacaatcggcactacccattttcaacgcgctttgattttcatcttactgacagccgtaaccccatcaatgact

SEQ ID NO: 1759 - RNA, 498 nt, synthetic construct
  misc_feature 1..498: note = derived and/or modified CDS sequence (opt3) from DENV-2 CYD2-T__prM
  source 1..498: mol_type = other RNA
ttccacctgaccacaagaaacggcgagccccatatgatcgtgagcaggcaggaaaaggggaaatccctcctttttaagactgaggacggagtcaatatgtgcacgctgatggccatggatttgggtgaattatgtgaggacaccattacatacaaatgccctctgctacggcaaaacgaaccagaggatatagactgttggtgcaattctacttcaacctgggttacatatggcacctgtactacaatgggggagcaccgccgagaaaagcgtagtgtggctctcgtaccgcatgtgggaatgggcctggagaccagaacggaaacttggatgagctccgagggtgcatggaaacacgtccagaggatcgagacctggattcttcggcatcccgggttcacaatgatggccgcgatcctggcttacactattggaaccacacactttcagcgcgccttgatcttcatactcctgaccgcagtgacgccttctatgact

SEQ ID NO: 1760 - RNA, 1485 nt, synthetic construct
  misc_feature 1..1485: note = derived and/or modified CDS sequence (opt3) from DENV-2 CYD2-T__E
  source 1..1485: mol_type = other RNA
atgagatgcatcggcatgagcaacagggacttcgtggagggggtctccggaggttcttgggttgatattgtgctggaacacggctcatgtgtaaccacaatggccaagaataaacccactctcgactttgagcttataaagacggaagctaaacagcctgcaaccctgcggaagtactgcatcgaggccaaattgacaaacactaccacagaaagtcgctgtccaacccaaggggagccgagcttaaatgaggaacaggataagcgattcgtgtgcaagcattccatggtcgaccgtggatggggcaacggttgtgggctgtttggaaaaggcggcattgtgacttgcgcgatgttcagatgtaagaaaaatatggaggggaaggttgtgcagcccgaaaacctagagtatacaatcgtcattacccctcactctggagaggaacatgctgtgggtaatgatacgggcaaacacgggaaggagatcaagataactccacagtcgtcaatcaccgaagccgagctcacaggatacggcactgtaaccatggaatgcagccccaggacaggtctggactttaacgagatggttcttctgcaaatggagaataaagcatggttggtgcatcggcagtggttcctcgatctgcctctgccatggctccccggggccgacacccagggaagtaactggattcagaaggaaacgttagtcacttttaaaaatcctcacgctaagaaacaagatgtggtggtcctgggctcccaggagggcgcaatgcacacagcccttaccggggctactgaaatccagatgtctagcggaaacttgctgttcacaggtcatctaaagtgtcgcctcagaatggacaaactgcagcttaagggcatgtcctattcaatgtgcaccgggaagtttaaagttgtgaaggagattgccgaaacgcaacacggaaccatcgtaataagggtgcagtacgagggcgatggtagtccatgtaaaattccgttcgagatcatggacctggaaaagcggcatgtcttggggcgcctcattacagtgaatcccatcgttactgagaaagatagccctgtgaacatcgaagcggagccaccctttggcgactcttatattataatcggagtcgaacctggccagctgaagttaaattggttcaagaaagggtcctcaattggacaaatgtttgagaccacaatgcgaggtgcaaagagaatggccatcctgggcgacactgcttgggatttcgggagcctcggaggcgtgttcaccagtataggtaaagcccttcaccaggtatttggggcaatttacggcgctgccttctctggagtttcctggacaatgaagatcctgatcggcgtgattatcacctggattgggatgaacagcaggtcgacttctttgtccgtcacgctagtgctggtcggaatagtgacactctatctgggtgttatggtgcaggcg

SEQ ID NO: 1761 - RNA, 1983 nt, synthetic construct
  misc_feature 1..1983: note = derived and/or modified CDS sequence (opt3) from DENV-2 CYD2-T__prME
  source 1..1983: mol_type = other RNA
ttccacctgaccacaagaaatggcgagccccatatgatcgtgagcaggcaggaaaaggggaaatccctcctttttaagactgaggacggagtcaatatgtgcacgctgatggccatggatttgggtgaattatgtgaggacaccattacatacaaatgccctctgctacggcaaaacgaaccagaggatatagactgttggtgcaattctacttcaacctgggttacatatggcacctgtactacaatgggggagcaccgccgagaaaagcgtagtgtggctctcgtaccgcatgtgggaatgggcctggagaccagaacggaaacttggatgagctccgagggtgcatggaaacacgtccagaggatcgagacctggattcttcggcatcccgggttcacaatgatggccgcgatcctggcttacactattggaaccacacactttcagcgcgccttgatcttcatactcctgaccgcagtgacgccttctatgactatgagatgcatcggcatgtcgaacagggattttgttgaaggcgtgtcagggggaagctgggtcgacattgtgctggagcacggtagttgtgtaacaaccatggccaagaataagccaactctcgatttcgaattaatcaaaacagaggctaagcagcccgcaaccctgcggaaatattgcattgaagccaaacttacgaacaccacaactgagtcccgctgtcctacccaaggcgagccatctttgaatgaggaacaggacaagcgatttgtttgcaagcatagcatggtggatagagggtggggaaacggctgtggtctgttcgggaagggaggcatcgtcacatgcgctatgtttaggtgcaaaaagaatatggaaggcaaagtggtgcagcccgagaacctagaatacactatagtcattacccctcactccggggaggagcatgccgttggaaatgacacaggtaagcacggcaaagaaatcaagattaccccacagtcaagtatcactgaggcggaactcacggggtatggaacagtgaccatggagtgtagcccgcggactggcctggatttcaacgaaatggtacttctgcaaatggagaataaagcatggttggtgcaccgtcagtggtttctcgacctgcccttaccttggctgccaggtgccgatacccaggggtctaactggatccagaaggagacactcgtcaccttcaagaatccccatgctaaaaagcaagacgtggttgtgcttggctcccaggaaggagccatgcacactgcactgacaggcgctacggagattcagatgtcaagcgggaacttgctatttaccggacatctgaaatgccgcctcagaatggacaagctgcaacttaaaggtatgagttactctatgtgtactggcaagttcaaggtcgtgaaagaaatagccgagacacagcacgggaccatcgtaattagggttcagtatgagggagatggctccccttgcaagatcccattcgaaataatggacctggagaaacggcatgtgttgggtcgactcattacagtcaaccccatcgtgactgaaaaggatagcccggtcaatatcgaggcggaacctccctttggggactcgtacattatcattggcgtggagccaggacagctgaaattaaactggttcaagaaggggtcttccataggccaaatgtttgagaccacgatgcgcggagccaaaagaatggcaatcctgggtgataccgcttgggacttcggctcactagggggagtttttacaagtattggcaaggccctccaccaggtgttcggtgctatctacggggccgcatttagcggcgtatcctggactatgaaaatcctgattggagtcataatcacctggattggcatgaactctaggagcacatcacttagtgtgactttggttctggtggggatcgtcaccctctatctgggagtgatggtacaggcc

SEQ ID NO: 1762 - RNA, 2025 nt, synthetic construct
  misc_feature 1..2025: note = derived and/or modified CDS sequence (opt3) from DENV-2 CYD2-T__SSc-prME
  source 1..2025: mol_type = other RNA
agcgccggcatgatcattatgctgatacccaccgtgatggctttccacctcacaactagaaacggggagcctcatatgatcgtctccaggcaggaaaagggaaaatctcttctgtttaagacggaggacggtgttaatatgtgcaccttgatggcaatggatttaggcgaactgtgtgaggacacaattacttacaaatgcccactactccggcaaaacgaaccggaggatatcgactgttggtgcaattcaaccagtacatgggtgacctatgggacttgtacaaccatgggagagcaccgccgagaaaagcgtagcgtagccctggtgccccatgtcggcatgggtcttgagacgagaactgaaacctggatgtcctctgagggggcgtggaaacacgtgcagaggattgagacatggatcctgcggcatcctggattcactatgatggctgccatattggcatacaccatcggcacaacccactttcagcgcgccctcattttcatcctgctgacggctgttactccatcgatgacaatgagatgcattggcatgtcaaacagggattttgtggaaggggtcagcggaggtagttgggtggacatcgtactcgagcacggctcctgtgttaccactatggcaaagaataagcccacattagatttcgaactgataaaaaccgaggccaagcagcctgctacgcttcggaaatattgcattgaagccaagttgaccaacacaactaccgagtctcgctgtccaacacaaggggagcccagcctgaatgaggaacaggacaaacgatttgtgtgcaagcattccatggtcgatagaggatggggcaacggttgtgggctattcggaaagggcggcatcgtgacttgcgcgatgtttaggtgcaaaaagaatatggaagggaaagtggtccagcctgagaacctcgaatacaccattgttatcacaccacactcaggagaggagcatgcagtgggtaatgacaccggcaagcacgggaaagaaatcaagattactccgcagagtagcataacggaggccgaactgacaggatatggcaccgtaactatggagtgttctccccggaccggtcttgatttcaacgaaatggtgctgttgcaaatggagaataaggcttggctcgtccaccgtcagtggtttctggacttacctctgccatggctccccggggccgatacacagggctccaactggatccagaaggagacccttgtgactttcaagaatcctcatgctaaaaagcaagacgttgtggtcctgggatcacaggaaggcgcaatgcacacagccttgacgggggcgaccgagattcagatgagcagtggaaacctactgtttactggtcatctcaaatgccgcctgagaatggacaaacttcaactgaaaggcatgtcttactccatgtgtacagggaagttcaaggtggtaaaagaaatcgccgagacccagcacggaacaatagttattagggtgcagtatgagggcgatggtagcccatgcaagatccccttcgaaatcatggacttggagaaacggcatgtcctcgggcgactgattactgtgaacccgatcgtcaccgaaaaggattcgcctgtgaatattgaggcagaacccccatttggcgactcttacataatcattggagttgagcctggccagttaaaactgaactggttcaagaaggggtcctcaatcggacaaatgtttgagacgaccatgcgcggtgctaaaagaatggccatcctaggcgatacagcttgggacttcgggagtctcggaggcgtgtttactagcattggtaaggccctgcaccaggtattcggggcaatatacggcgccgctttttccggagtctcttggaccatgaaaatccttattggcgtgatcattacatggatcgggatgaatagcaggtcaaccagtttgtccgttactctggtgctcgtcggaatagtgacgctgtatcttggcgtaatggtgcaggcg

SEQ ID NO: 1763 - RNA, 2325 nt, synthetic construct
  misc_feature 1..2325: note = derived and/or modified CDS sequence (opt3) from DENV-2 CYD2-T__C-prME
  source 1..2325: mol_type = other RNA
atgaataatcagagaaagaaagccaagaacacccccttcaatatgctgaaaagggagcggaaccgcgtgagcacagtccaacagctcactaagcgattttcccttggcatgctgcaggggcgtggacctttgaaattattcatggctctggttgcatttctaagattcctcacgatcccaccgaccgccggtattctgaagaggtggggcacaataaagaaatctaaggcgatcaatgtgcttcgggggtttcgcaaagaaattggaagaatgctgaacatcttgaataggcggcgccgatcagctggcatgattatcatgctcatacccactgtaatggccttccacctgaccacaagaaacggtgagcctcatatgatcgtgagtaggcaggaaaaggggaaaagcctgctctttaagaccgaggacggagtcaatatgtgcactttaatggcaatggatctgggcgaactttgtgaggacacaattacctacaagtgcccattgctgcggcaaaacgagcccgaagatatcgactgttggtgcaattccacgtctacttgggtgacctatggcacatgtactaccatgggggagcaccgtcgcgaaaagagatcggttgccctagtgcctcatgtcggaatgggtctcgagacaaggaccgagacgtggatgtcaagcgaaggcgcttggaagcacgtgcagcggattgagacttggatcctgcgacatccagggttcacaatgatggcagccatacttgcttacaccattggaactacacactttcagcgcgccctgatcttcattttgctcaccgcggtaacgcccagtatgaccatgagatgcatcggcatgtccaacagggattttgttgaaggtgtgtctgggggaagctgggtcgacatcgtgctggagcacggctcctgtgtgacaactatggccaaaaataagcctaccttagatttcgaactgattaaaacagaggcaaagcagccagctactctccggaaatattgcatagaggccaaacttaccaacacaaccactgaatcacgctgtccgacgcaaggcgagcccagtctgaatgaagaacaggacaagagatttgtctgcaaacatagcatggttgatagggggtggggaaacggttgtggcttgttcgggaagggaggcatcgtgacatgcgcaatgttccgttgcaaaaagaacatggaaggtaaagtagtgcagcctgagaatctagagtacaccattgtcatcactccacactctggggaggagcatgctgtgggcaacgacaccggaaagcacggcaaggaaataaaaattacaccccagtcctcaatcaccgaggccgaactgactgggtatggaacagttacgatggagtgtagccctcggaccggtctcgattttaatgagatggtgctgcttcaaatggaaaacaaggcgtggctggtccaccgacagtggttcttggacctcccactgccctggttaccgggcgccgatactcaggggagtaattggatccaaaaagagacactggtgacctttaagaaccctcatgctaaaaagcaggacgtagttgtgctaggatctcaggaaggcgcaatgcacacagccctcactggtgctaccgagattcagatgtccagcgggaatctgcttttcacgggccatttgaagtgcagactgaggatggacaaactccaactgaagggaatgtcgtactctatgtgtaccggcaaatttaaggtcgtgaaagagatcgccgaaacacagcacgggactattgtcatacgcgtgcagtatgagggagatggttccccctgcaagatcccattcgaaattatggaccttgagaagcggcatgttctgggcagattgatcaccgtgaaccctatcgtaacagaaaaagattcacccgtcaatattgaggcagagccaccctttggggacagttacataatcattggagtggaacctggccagctcaagctgaactggttcaaaaagggtagctccatcgggcaaatgtttgagactaccatgaggggcgccaaacgcatggctattttaggagatacggcgtgggacttcggctctctagggggagtttttacaagcatcggcaaggcactgcaccaggtgttcggtgccatatacggggctgccttttcaggagtcagttggaccatgaaaatcctcattggcgtgatcattacttggatcggtatgaactcccgaagcacatctctgtcagtaacccttgtgttggttggcatagtcactctgtatctcggggtgatggtgcaggca

SEQ ID NO: 1764 - RNA, 45 nt, synthetic construct
  misc_feature 1..45: note = derived and/or modified CDS sequence (opt3) from DENV-2 CYD2-T__SSc
  source 1..45: mol_type = other RNA
atgagcgccggcatgatcattatgctgatacccaccgtgatggct

SEQ ID NO: 1765 - RNA, 57 nt, synthetic construct
  misc_feature 1..57: note = derived and/or modified CDS sequence (opt3) from DENV-2 CYD2-T__SSopt
  source 1..57: mol_type = other RNA
atgaagagaaagaaaagcgccggcatgatcattatgctgatacccaccgtgatggct

SEQ ID NO: 1766 - RNA, 57 nt, synthetic construct
  misc_feature 1..57: note = derived and/or modified CDS sequence (opt3) from DENV-2 CYD2-T__SSm
  source 1..57: mol_type = other RNA
atgttccagagagccctgatctttattctccttaccgctgtgacacccagcatgact

SEQ ID NO: 1767 - RNA, 1488 nt, synthetic construct
  misc_feature 1..1488: note = derived and/or modified CDS sequence (opt3) from DENV-2 CYD2-T__E
  source 1..1488: mol_type = other RNA
atgagatgcatcggcatgagcaacagggacttcgtggagggggtctccggaggttcttgggttgatattgtgctggaacacggctcatgtgtaaccacaatggccaagaataaacccactctcgactttgagcttataaagacggaagctaaacagcctgcaaccctgcggaagtactgcatcgaggccaaattgacaaacactaccacagaaagtcgctgtccaacccaaggggagccgagcttaaatgaggaacaggataagcgattcgtgtgcaagcattccatggtcgaccgtggatggggcaacggttgtgggctgtttggaaaaggcggcattgtgacttgcgcgatgttcagatgtaagaaaaatatggaggggaaggttgtgcagcccgaaaacctagagtatacaatcgtcattacccctcactctggagaggaacatgctgtgggtaatgatacgggcaaacacgggaaggagatcaagataactccacagtcgtcaatcaccgaagccgagctcacaggatacggcactgtaaccatggaatgcagccccaggacaggtctggactttaacgagatggttcttctgcaaatggagaataaagcatggttggtgcatcggcagtggttcctcgatctgcctctgccatggctccccggggccgacacccagggaagtaactggattcagaaggaaacgttagtcacttttaaaaatcctcacgctaagaaacaagatgtggtggtcctgggctcccaggagggcgcaatgcacacagcccttaccggggctactgaaatccagatgtctagcggaaacttgctgttcacaggtcatctaaagtgtcgcctcagaatggacaaactgcagcttaagggcatgtcctattcaatgtgcaccgggaagtttaaagttgtgaaggagattgccgaaacgcaacacggaaccatcgtaataagggtgcagtacgagggcgatggtagtccatgtaaaattccgttcgagatcatggacctggaaaagcggcatgtcttggggcgcctcattacagtgaatcccatcgttactgagaaagatagccctgtgaacatcgaagcggagccaccctttggcgactcttatattataatcggagtcgaacctggccagctgaagttaaattggttcaagaaagggtcctcaattggacaaatgtttgagaccacaatgcgaggtgcaaagagaatggccatcctgggcgacactgcttgggatttcgggagcctcggaggcgtgttcaccagtataggtaaagcccttcaccaggtatttggggcaatttacggcgctgccttctctggagtttcctggacaatgaagatcctgatcggcgtgattatcacctggattgggatgaacagcaggtcgacttctttgtccgtcacgctagtgctggtcggaatagtgacactctatctgggtgttatggtgcaggcgtga

SEQ ID NO: 1768 - RNA, 1182 nt, synthetic construct
  misc_feature 1..1182: note = derived and/or modified CDS sequence (opt3) from DENV-2 CYD2-T__EdelTM-variant (aa1-394)
  source 1..1182: mol_type = other RNA
atgagatgcatcggcatgagcaacagggacttcgtggagggggtctccggaggttcttgggttgatattgtgctggaacacggctcatgtgtaaccacaatggccaagaataaacccactctcgactttgagcttataaagacggaagctaaacagcctgcaaccctgcggaagtactgcatcgaggccaaattgacaaacactaccacagaaagtcgctgtccaacccaaggggagccgagcttaaatgaggaacaggataagcgattcgtgtgcaagcattccatggtcgaccgtggatggggcaacggttgtgggctgtttggaaaaggcggcattgtgacttgcgcgatgttcagatgtaagaaaaatatggaggggaaggttgtgcagcccgaaaacctagagtatacaatcgtcattacccctcactctggagaggaacatgctgtgggtaatgatacgggcaaacacgggaaggagatcaagataactccacagtcgtcaatcaccgaagccgagctcacaggatacggcactgtaaccatggaatgcagccccaggacaggtctggactttaacgagatggttcttctgcaaatggagaataaagcatggttggtgcatcggcagtggttcctcgatctgcctctgccatggctccccggggccgacacccagggaagtaactggattcagaaggaaacgttagtcacttttaaaaatcctcacgctaagaaacaagatgtggtggtcctgggctcccaggagggcgcaatgcacacagcccttaccggggctactgaaatccagatgtctagcggaaacttgctgttcacaggtcatctaaagtgtcgcctcagaatggacaaactgcagcttaagggcatgtcctattcaatgtgcaccgggaagtttaaagttgtgaaggagattgccgaaacgcaacacggaaccatcgtaataagggtgcagtacgagggcgatggtagtccatgtaaaattccgttcgagatcatggacctggaaaagcggcatgtcttggggcgcctcattacagtgaatcccatcgttactgagaaagatagccctgtgaacatcgaagcggagccaccctttggcgactcttatattataatcggagtcgaacctggccagctgaagttaaattggttcaagaaa

SEQ ID NO: 1769 - RNA, 1272 nt, synthetic construct
  misc_feature 1..1272: note = derived and/or modified CDS sequence (opt3) from DENV-2 CYD2-T__EdelTM-variant (aa1-424)
  source 1..1272: mol_type = other RNA
atgagatgcatcggcatgagcaacagggacttcgtggagggggtctccggaggttcttgggttgatattgtgctggaacacggctcatgtgtaaccacaatggccaagaataaacccactctcgactttgagcttataaagacggaagctaaacagcctgcaaccctgcggaagtactgcatcgaggccaaattgacaaacactaccacagaaagtcgctgtccaacccaaggggagccgagcttaaatgaggaacaggataagcgattcgtgtgcaagcattccatggtcgaccgtggatggggcaacggttgtgggctgtttggaaaaggcggcattgtgacttgcgcgatgttcagatgtaagaaaaatatggaggggaaggttgtgcagcccgaaaacctagagtatacaatcgtcattacccctcactctggagaggaacatgctgtgggtaatgatacgggcaaacacgggaaggagatcaagataactccacagtcgtcaatcaccgaagccgagctcacaggatacggcactgtaaccatggaatgcagccccaggacaggtctggactttaacgagatggttcttctgcaaatggagaataaagcatggttggtgcatcggcagtggttcctcgatctgcctctgccatggctccccggggccgacacccagggaagtaactggattcagaaggaaacgttagtcacttttaaaaatcctcacgctaagaaacaagatgtggtggtcctgggctcccaggagggcgcaatgcacacagcccttaccggggctactgaaatccagatgtctagcggaaacttgctgttcacaggtcatctaaagtgtcgcctcagaatggacaaactgcagcttaagggcatgtcctattcaatgtgcaccgggaagtttaaagttgtgaaggagattgccgaaacgcaacacggaaccatcgtaataagggtgcagtacgagggcgatggtagtccatgtaaaattccgttcgagatcatggacctggaaaagcggcatgtcttggggcgcctcattacagtgaatcccatcgttactgagaaagatagccctgtgaacatcgaagcggagccaccctttggcgactcttatattataatcggagtcgaacctggccagctgaagttaaattggttcaagaaagggtcctcaattggacaaatgtttgagaccacaatgcgaggtgcaaagagaatggccatcctgggcgacactgcttgggatttcgggagc

SEQ ID NO: 1770 - RNA, 1263 nt, synthetic construct
  misc_feature 1..1263: note = derived and/or modified CDS sequence (opt3) from DENV-2 CYD2-T__EdelTM-variant (aa1-421)
  source 1..1263: mol_type = other RNA
atgagatgcatcggcatgagcaacagggacttcgtggagggggtctccggaggttcttgggttgatattgtgctggaacacggctcatgtgtaaccacaatggccaagaataaacccactctcgactttgagcttataaagacggaagctaaacagcctgcaaccctgcggaagtactgcatcgaggccaaattgacaaacactaccacagaaagtcgctgtccaacccaaggggagccgagcttaaatgaggaacaggataagcgattcgtgtgcaagcattccatggtcgaccgtggatggggcaacggttgtgggctgtttggaaaaggcggcattgtgacttgcgcgatgttcagatgtaagaaaaatatggaggggaaggttgtgcagcccgaaaacctagagtatacaatcgtcattacccctcactctggagaggaacatgctgtgggtaatgatacgggcaaacacgggaaggagatcaagataactccacagtcgtcaatcaccgaagccgagctcacaggatacggcactgtaaccatggaatgcagccccaggacaggtctggactttaacgagatggttcttctgcaaatggagaataaagcatggttggtgcatcggcagtggttcctcgatctgcctctgccatggctccccggggccgacacccagggaagtaactggattcagaaggaaacgttagtcacttttaaaaatcctcacgctaagaaacaagatgtggtggtcctgggctcccaggagggcgcaatgcacacagcccttaccggggctactgaaatccagatgtctagcggaaacttgctgttcacaggtcatctaaagtgtcgcctcagaatggacaaactgcagcttaagggcatgtcctattcaatgtgcaccgggaagtttaaagttgtgaaggagattgccgaaacgcaacacggaaccatcgtaataagggtgcagtacgagggcgatggtagtccatgtaaaattccgttcgagatcatggacctggaaaagcggcatgtcttggggcgcctcattacagtgaatcccatcgttactgagaaagatagccctgtgaacatcgaagcggagccaccctttggcgactcttatattataatcggagtcgaacctggccagctgaagttaaattggttcaagaaagggtcctcaattggacaaatgtttgagaccacaatgcgaggtgcaaagagaatggccatcctgggcgacactgcttgggat

SEQ ID NO: 1771 - RNA, 2031 nt, synthetic construct
  misc_feature 1..2031: note = derived and/or modified CDS sequence (opt3) from DENV-2 CYD2-T__SSc-prME
  source 1..2031: mol_type = other RNA
atgagcgccggcatgatcattatgctgatacccaccgtgatggctttccacctcacaactagaaacggggagcctcatatgatcgtctccaggcaggaaaagggaaaatctcttctgtttaagacggaggacggtgttaatatgtgcaccttgatggcaatggatttaggcgaactgtgtgaggacacaattacttacaaatgcccactactccggcaaaacgaaccggaggatatcgactgttggtgcaattcaaccagtacatgggtgacctatgggacttgtacaaccatgggagagcaccgccgagaaaagcgtagcgtagccctggtgccccatgtcggcatgggtcttgagacgagaactgaaacctggatgtcctctgagggggcgtggaaacacgtgcagaggattgagacatggatcctgcggcatcctggattcactatgatggctgccatattggcatacaccatcggcacaacccactttcagcgcgccctcattttcatcctgctgacggctgttactccatcgatgacaatgagatgcattggcatgtcaaacagggattttgtggaaggggtcagcggaggtagttgggtggacatcgtactcgagcacggctcctgtgttaccactatggcaaagaataagcccacattagatttcgaactgataaaaaccgaggccaagcagcctgctacgcttcggaaatattgcattgaagccaagttgaccaacacaactaccgagtctcgctgtccaacacaaggggagcccagcctgaatgaggaacaggacaaacgatttgtgtgcaagcattccatggtcgatagaggatggggcaacggttgtgggctattcggaaagggcggcatcgtgacttgcgcgatgtttaggtgcaaaaagaatatggaagggaaagtggtccagcctgagaacctcgaatacaccattgttatcacaccacactcaggagaggagcatgcagtgggtaatgacaccggcaagcacgggaaagaaatcaagattactccgcagagtagcataacggaggccgaactgacaggatatggcaccgtaactatggagtgttctccccggaccggtcttgatttcaacgaaatggtgctgttgcaaatggagaataaggcttggctcgtccaccgtcagtggtttctggacttacctctgccatggctccccggggccgatacacagggctccaactggatccagaaggagacccttgtgactttcaagaatcctcatgctaaaaagcaagacgttgtggtcctgggatcacaggaaggcgcaatgcacacagccttgacgggggcgaccgagattcagatgagcagtggaaacctactgtttactggtcatctcaaatgccgcctgagaatggacaaacttcaactgaaaggcatgtcttactccatgtgtacagggaagttcaaggtggtaaaagaaatcgccgagacccagcacggaacaatagttattagggtgcagtatgagggcgatggtagcccatgcaagatccccttcgaaatcatggacttggagaaacggcatgtcctcgggcgactgattactgtgaacccgatcgtcaccgaaaaggattcgcctgtgaatattgaggcagaacccccatttggcgactcttacataatcattggagttgagcctggccagttaaaactgaactggttcaagaaggggtcctcaatcggacaaatgtttgagacgaccatgcgcggtgctaaaagaatggccatcctaggcgatacagcttgggacttcgggagtctcggaggcgtgtttactagcattggtaaggccctgcaccaggtattcggggcaatatacggcgccgctttttccggagtctcttggaccatgaaaatccttattggcgtgatcattacatggatcgggatgaatagcaggtcaaccagtttgtccgttactctggtgctcgtcggaatagtgacgctgtatcttggcgtaatggtgcaggcgtga

SEQ ID NO: 1772 - RNA, 2031 nt, synthetic construct
  misc_feature 1..2031: note = derived and/or modified CDS sequence (opt3) from DENV-2 CYD2-T__SSc-prME(F108S)
  source 1..2031: mol_type = other RNA
atgagcgccggcatgatcattatgctgatacccaccgtgatggctttccacctcacaactagaaatggggagcctcatatgatcgtctccaggcaggaaaagggaaaatctcttctgtttaagacggaggacggtgttaatatgtgcaccttgatggcaatggatttaggcgaactgtgtgaggacacaattacttacaaatgcccactactccggcaaaacgaaccggaggatatcgactgttggtgcaattcaaccagtacatgggtgacctatgggacttgtacaaccatgggagagcaccgccgagaaaagcgtagcgtagccctggtgccccatgtcggcatgggtcttgagacgagaactgaaacctggatgtcctctgagggggcgtggaaacacgtgcagaggattgagacatggatcctgcggcatcctggattcactatgatggctgccatattggcatacaccatcggcacaacccactttcagcgcgccctcattttcatcctgctgacggctgttactccatcgatgacaatgagatgcattggcatgtcaaacagggattttgtggaaggggtcagcggaggtagttgggtggacatcgtactcgagcacggctcctgtgttaccactatggcaaagaataagcccacattagatttcgaactgataaaaaccgaggccaagcagcctgctacgcttcggaaatattgcattgaagccaagttgaccaacacaactaccgagtctcgctgtccaacacaaggggagcccagcctgaatgaggaacaggacaaacgatttgtgtgcaagcattccatggtcgatagaggatggggcaacggttgtgggctatcaggaaagggcggcatcgtgacttgcgcgatgttcaggtgcaaaaagaatatggaagggaaagtggtccagcctgagaacctcgaatacaccattgttatcacaccacacagtggagaggagcatgcagtgggtaatgacaccggcaagcacgggaaagaaatcaagattactccgcagagctctataacggaggccgaactgacaggatatggcaccgtaactatggagtgttcaccccggaccggtcttgattttaacgaaatggtgctgttgcaaatggagaataaggcttggctcgtccaccgtcagtggttcctggacttacctctgccatggctccccggggccgatacacagggctccaactggatccagaaggagacccttgtgacttttaagaatcctcatgctaaaaagcaagacgttgtggtcctgggaagccaggaaggcgcaatgcacacagccttgacgggggcgaccgagattcagatgagttctggaaacctactgttcactggtcatctcaaatgccgcctgagaatggacaaacttcaactgaaaggcatgtcctacagcatgtgtacagggaagtttaaggtggtaaaagaaatcgccgagacccagcacggaacaatagttattagggtgcagtatgagggcgatggttcgccatgcaagatccccttcgaaatcatggacttggagaaacggcatgtcctcgggcgactgattactgtgaacccgatcgtcaccgaaaaggattctcctgtgaatattgaggcagaacccccattcggcgactcctacataatcattggagttgagcctggccagttaaaactgaactggtttaagaaggggtcaagtatcggacaaatgttcgagacgaccatgcgcggtgctaaaagaatggccatcctaggcgatacagcttgggactttgggagcctcggaggcgtgttcacttccattggtaaggccctgcaccaggtatttggggcaatatacggcgccgctttctctggagtcagctggaccatgaaaatccttattggcgtgatcattacatggatcgggatgaactcaaggagtacttccttgagcgttaccctggtgctcgtcggaatagtgacgctgtatcttggcgtaatggtgcaggcgtga

SEQ ID NO: 1773 - RNA, 2031 nt, synthetic construct
  misc_feature 1..2031: note = derived and/or modified CDS sequence (opt3) from DENV-2 CYD2-T__SSc-prMEdelstem_TM-JEV
  source 1..2031: mol_type = other RNA
atgagcgccggcatgatcattatgctgatacccaccgtgatggctttccacctcacaactagaaacggggagcctcatatgatcgtctccaggcaggaaaagggaaaatctcttctgtttaagacggaggacggtgttaatatgtgcaccttgatggcaatggatttaggcgaactgtgtgaggacacaattacttacaaatgcccactactccggcaaaacgaaccggaggatatcgactgttggtgcaattcaaccagtacatgggtgacctatgggacttgtacaaccatgggagagcaccgccgagaaaagcgtagcgtagccctggtgccccatgtcggcatgggtcttgagacgagaactgaaacctggatgtcctctgagggggcgtggaaacacgtgcagaggattgagacatggatcctgcggcatcctggattcactatgatggctgccatattggcatacaccatcggcacaacccactttcagcgcgccctcattttcatcctgctgacggctgttactccatcgatgacaatgagatgcattggcatgtcaaacagggattttgtggaaggggtcagcggaggtagttgggtggacatcgtactcgagcacggctcctgtgttaccactatggcaaagaataagcccacattagatttcgaactgataaaaaccgaggccaagcagcctgctacgcttcggaaatattgcattgaagccaagttgaccaacacaactaccgagtctcgctgtccaacacaaggggagcccagcctgaatgaggaacaggacaaacgatttgtgtgcaagcattccatggtcgatagaggatggggcaacggttgtgggctattcggaaagggcggcatcgtgacttgcgcgatgtttaggtgcaaaaagaatatggaagggaaagtggtccagcctgagaacctcgaatacaccattgttatcacaccacactcaggagaggagcatgcagtgggtaatgacaccggcaagcacgggaaagaaatcaagattactccgcagagtagcataacggaggccgaactgacaggatatggcaccgtaactatggagtgttctccccggaccggtcttgatttcaacgaaatggtgctgttgcaaatggagaataaggcttggctcgtccaccgtcagtggtttctggacttacctctgccatggctccccggggccgatacacagggctccaactggatccagaaggagacccttgtgactttcaagaatcctcatgctaaaaagcaagacgttgtggtcctgggatcacaggaaggcgctatgcacacagccttgacgggggcgaccgagattcagatgagcagtggaaacctactgtttactggtcatctcaaatgccgcctgagaatggacaaacttcaactgaaaggcatgtcttactccatgtgtacagggaagttcaaggtggtaaaagaaatcgccgagacccagcacggaacaatagttattagggtgcagtatgagggcgatggtagcccatgcaagatccccttcgaaatcatggacttggagaaacggcatgtcctcgggcgactgattactgtgaacccgatcgtcaccgaaaaggattcgcctgtgaatattgaggcagaacccccatttggcgactcttacataatcattggagttgagcctggccagttaaaactgaactggttcaagaaggggtccacgctaggaaaggctttttcaaccacactcaaaggtgcccaacgcctggctgcccttggcgatactgcatgggacttcgggagtatcggaggcgtgtttaatagcatcggtagagccgtacaccaggtcttcgggggcgcttttaggaccttgttcggaggcatgtcctggattacacaggggctgatgggagcgctcctgctttggatgggcgtgaacgcacgggatcgctctatagccctggcatttttggccactggtggggttctcgtgttcctggcaaccaatgtccacgcctga

SEQ ID NO: 1774 - RNA, 1332 nt, synthetic construct
  misc_feature 1..1332: note = derived and/or modified CDS sequence (opt3) from DENV-2 CYD2-T__SSm-EdelTM
  source 1..1332: mol_type = other RNA
atgttccagagagccctgatctttattctccttaccgctgtgacacccagcatgactatgaggtgcataggcatgtccaaccgggacttcgtcgagggggtttctggaggttcatgggtggatatcgtactggaacacggcagttgtgtgacgaccatggcaaagaataaacctacattggactttgagttaattaagactgaagccaaacaaccagcgaccctgcgcaagtactgcatcgaggctaaactaacaaacaccactacagaaagccgatgtccgacccagggggagccctccctcaatgaggaacaggataagcgtttcgtctgcaagcattctatggtggacagaggatggggcaacggttgtgggctgtttggaaaaggcggcattgttacgtgcgccatgttcaggtgtaagaaaaatatggaggggaaggtggtccagcctgaaaaccttgagtatactatcgtgataaccccacactcgggagaggaacatgcagtaggtaatgatacaggcaaacacgggaaggagatcaagattactccccaatcaagcatcaccgaagccgagctgacaggatacggcaccgttacgatggaatgcagtcctcggactggtttggactttaacgagatggtgctcctgcagatggagaataaggcttggctggtccatcgccagtggttcctcgatttaccactgccctggcttcctggggcagacacacagggatccaactggattcaaaaggaaaccttggtgacttttaaaaatccacacgccaagaaacaggatgtggtcgttctgggctctcaggagggcgctatgcacacagccctaaccggggcgacggaaatccagatgagctccggaaacctcctgttcaccggtcatcttaagtgtagactgaggatggacaaattgcaactcaagggcatgtcatatagtatgtgcacagggaagtttaaagtggtaaaggagatagcagaaactcagcacggaaccattgtgatccgggtccagtacgagggcgatggtagcccgtgtaaaattcccttcgagatcatggacctggaaaagcgccatgtgttagggcgactgatcacagttaatcctattgtgactgagaaagattctccagtcaacatagaagccgagcccccttttggcgactcctatatcattatcggagtggaaccaggccaactcaaacttaattggttcaagaaagggtcaagcataggacagatgttcgagaccacaatgagaggtgctaagaggatggccattctgggcgacaccgcatgggattttgggagttga

SEQ ID NO: 1775 - RNA, 2379 nt, synthetic construct
  misc_feature 1..2379: note = derived and/or modified CDS sequence (opt3) from DENV-2 CYD2-T__C-P2A-SSc-prME
  source 1..2379: mol_type = other RNA
atgaacaatcagagaaagaaagccaagaacacccccttcaatatgctgaaaagggagcggaaccgcgtgagcacagtccaacagctcactaagcgattttcccttggcatgctgcaggggcgtggacctttgaaattattcatggctctggttgcatttctaagattcctcacgatcccaccgaccgccggtattctgaagaggtggggcacaataaagaaatctaaggcgatcaatgtgcttcgggggtttcgcaaagaaattggaagaatgctgaacatcttgaataggcggcgccgaaacttcgacctcctgaagctggctggcgatgtagagtcaaatcccggtcctagtgccgggatgattatcatgctcataccaactgtgatggcatttcacttaaccacaagaaacggagaaccccatatgatcgtcagcaggcaggagaaaggcaagtccctgcttttcaagaccgaagacggcgtgaatatgtgcactttgatggccatggatctgggggagctatgtgaggacacaattacctacaaatgccctctcctgcggcaaaacgaaccagaggatatcgactgttggtgcaattctacgtcgacttgggttacctatggaacatgtactaccatgggtgaacaccgtcgcgagaagagatcagtggctcttgtcccccatgtgggcatggggctggagacaaggaccgaaacgtggatgagcagtgagggagcatggaaacacgtacagcggattgaaacttggatcttgcgacatcctggctttacaatgatggccgctatactcgcctacaccattggtactacacacttccagcgcgcgctgatctttattttactgaccgcagttacgccatccatgaccatgagatgcatcgggatgtctaacagggatttcgtggagggagtcagcggcggctcctgggtggacatcgtgctcgaacacgggtcatgtgtcacaactatggccaagaataaaccgacccttgattttgagctgattaagacagaggctaaacagcccgccactttgcggaagtattgcatagaagcaaagctaaccaacacaaccactgagagtcgctgtcctacgcaaggagaaccaagcctgaacgaggaacaggacaaaagattcgtttgcaagcattctatggtggataggggttggggcaatgggtgtggactcttcggcaaaggtgggatcgtaacatgcgctatgtttcgttgcaagaaaaacatggagggcaaggtggtccagcccgagaatctggaatacaccattgtgatcactcctcactccggagaggaacatgccgttggcaacgacaccgggaagcacggaaaagagataaagattacaccacagtcaagcatcaccgaagcggagcttactggttatggcacagtgacgatggagtgtagtccccggaccgggctggatttcaatgaaatggtcttgctccaaatggagaacaaagcctggctggtgcaccgacagtggtttttagacctgccgctaccttggctccccggagcagacactcagggctctaattggatccaaaaggaaacactggtaaccttcaaaaacccacatgctaagaagcaggatgttgtggtccttggttcccaggagggggccatgcacacagctttgactggcgccaccgagattcagatgagctcgggaaatctgctctttacgggccatctgaaatgcagacttaggatggacaagctgcaattgaaagggatgtcttactccatgtgtaccggaaagttcaaagtggtcaaggaaatcgcagagacacagcacggtactattgtgatacgcgttcagtatgaaggcgatgggtcaccttgcaagatcccctttgagattatggacctcgaaaaacggcatgtgctgggaagattaatcaccgtaaacccaatcgtcacagagaaggatagtcccgtgaatattgaggccgaacctccattcggcgacagctacataatcattggtgttgagccggggcagctgaaactaaactggtttaagaaaggctcctctatcggacaaatgttcgaaactaccatgaggggcgctaagcgcatggcgattctcggggatacggcatgggactttggaagcctgggcggtgtgttcacatcaatcgggaaagcccttcaccaggtctttggagctatatacggcgccgcattcagtggtgtgtcctggaccatgaagatcttgattggcgtaatcattacttggatcgggatgaatagccgatctacatcactgagtgtgaccctcgttctggtcggaatagtgactttatatctgggcgtgatggtccaggcctga

SEQ ID NO: 1776 - RNA, 2043 nt, synthetic construct
  misc_feature 1..2043: note = derived and/or modified CDS sequence (opt3) from DENV-2 CYD2-T__SSopt-prME(F108S)
  source 1..2043: mol_type = other RNA
atgaagcgtaaaaagagcgccggcatgatcattatgctgatacccaccgtgatggctttccacctcacaactaggaatggggagcctcatatgatcgtctcccggcaggaaaaaggaaagtctcttctgtttaaaacggaggacggtgttaatatgtgcaccttgatggcaatggatttaggcgaactgtgtgaggacacaattacttacaagtgcccactactccgccaaaacgaaccggaggatatcgactgttggtgcaattcaaccagtacatgggtgacctatgggacttgtacaaccatgggagagcaccgacgtgaaaagagaagcgtagccctggtgccccatgtcggcatgggtcttgagacgaggactgaaacctggatgtcctctgagggggcgtggaaacacgtgcagcggattgagacatggatcctgcgccatcctggattcactatgatggctgccatattggcatacaccatcggcacaacccactttcagagagccctcattttcatcctgctgacggctgttactccatcgatgacaatgaggtgcattggcatgtcaaaccgggattttgtggaaggggtcagcggaggtagttgggtggacatcgtactcgagcacggctcctgtgttaccactatggcaaagaataaacccacattagatttcgaactgataaagaccgaggccaaacagcctgctacgcttcgcaagtattgcattgaagccaagttgaccaacacaactaccgagtctcgatgtccaacacaaggggagcccagcctgaatgaggaacaggacaaaagatttgtgtgcaagcattccatggtcgataggggatggggcaacggttgtgggctatcaggaaaaggcggcatcgtgacttgcgcgatgttccggtgcaagaaaaatatggaagggaaggtggtccagcctgagaacctcgaatacaccattgttatcacaccacacagtggagaggagcatgcagtgggtaatgacaccggcaaacacgggaaggaaatcaagattactccgcagagctctataacggaggccgaactgacaggatatggcaccgtaactatggagtgttcccccagaaccggtcttgattttaacgaaatggtgctgttgcaaatggagaataaggcttggctcgtccaccgccagtggttcctggacttacctctgccatggctccccggggccgatacacagggctcaaactggatccagaaggagacccttgtgacttttaaaaatcctcatgcaaagaaacaagacgttgtggtcctgggaagccaggaaggcgctatgcacacagccttgacgggggcgaccgagattcagatgagttctggaaacctactgttcactggtcatctcaagtgcagactgaggatggacaaacttcaactgaaaggcatgtcctacagcatgtgtacagggaagtttaaagtggtaaaggaaatcgccgagacccagcacggaacaatagttattcgggtgcagtatgagggcgatggttcgccatgcaaaatccccttcgaaatcatggacttggagaagcgacatgtcctcgggcgcctgattactgtgaacccgatcgtcaccgaaaaggattctcctgtgaatattgaggcagaacccccattcggcgactcctacataatcattggagttgagcctggccagttaaaactgaactggtttaagaaagggtcaagtatcggacaaatgttcgagacgaccatgagaggtgctaagaggatggccatcctaggcgatacagcttgggactttgggagcctcggaggcgtgttcacttccattggtaaagccctgcaccaggtatttggggcaatatacggcgccgctttctctggagtcagctggaccatgaagatccttattggcgtgatcattacatggatcgggatgaactcacggagtacttccttgagcgttaccctggtgctcgtcggaatagtgacgctgtatcttggcgtaatggtgcaggcgtga

SEQ ID NO: 1777 - RNA, 2043 nt, synthetic construct
  misc_feature 1..2043: note = derived and/or modified CDS sequence (opt3) from DENV-2 CYD2-T__SSopt-prME(M96H)
  source 1..2043: mol_type = other RNA
atgaagaggaaaaagagcgccggcatgatcattatgctgatacccaccgtgatggctttccacctcacaactagaaacggggagcctcatatgatcgtctcccggcaggaaaaaggaaagtctcttctgtttaaaacggaggacggtgttaatatgtgcaccttgatggcaatggatttaggcgaactgtgtgaggacacaattacttacaagtgcccactactccgccaaaacgaaccggaggatatcgactgttggtgcaattcaaccagtacatgggtgacctatgggacttgtacaaccatgggagagcaccgacgtgaaaagagaagcgtagccctggtgccccatgtcggcatgggtcttgagacgaggactgaaacctggatgtcctctgagggggcgtggaaacacgtgcagcggattgagacatggatcctgcgccatcctggattcactatgatggctgccatattggcatacaccatcggcacaacccactttcagagagccctcattttcatcctgctgacggctgttactccatcgatgacaatgaggtgcattggcatgtcaaaccgggattttgtggaaggggtcagcggaggtagttgggtggacatcgtactcgagcacggctcctgtgttaccactatggcaaagaataaacccacattagatttcgaactgataaagaccgaggccaaacagcctgctacgcttcgcaagtattgcattgaagccaagttgaccaacacaactaccgagtctcgatgtccaacacaaggggagcccagcctgaatgaggaacaggacaaaagatttgtgtgcaagcattcccacgtcgataggggatggggcaacggttgtgggctattcggaaaaggcggcatcgtgacttgcgcgatgtttcggtgcaagaaaaatatggaagggaaggtggtccagcctgagaacctcgaatacaccattgttatcacaccacattcaggagaggagcacgcagtgggtaatgacaccggcaaacacgggaaggaaatcaagattactccgcagagtagcataacggaggccgaactgacaggatatggcaccgtaactatggagtgttctccccgtaccggtcttgatttcaacgaaatggtgctgttgcaaatggagaataaggcttggctcgtccatcgccagtggtttctggacttacctctgccatggctccccggggccgatacacagggctccaactggatccagaaggagacccttgtgactttcaaaaatcctcacgcaaagaaacaagacgttgtggtcctgggatcacaggaaggcgctatgcatacagccttgacgggggcgaccgagattcagatgagcagtggaaacctactgtttactggtcacctcaagtgcagactgaggatggacaaacttcaactgaaaggcatgtcttactccatgtgtacagggaagttcaaagtggtaaaggaaatcgccgagacccagcatggaacaatagttattcgggtgcagtatgagggcgatggtagcccatgcaaaatccccttcgaaatcatggacttggagaagcgacacgtcctcgggcgcctgattactgtgaacccgatcgtcaccgaaaaggattcgcctgtgaatattgaggcagaacccccatttggcgactcttacataatcattggagttgagcctggccagttaaaactgaactggttcaagaaagggtcctcaatcggacaaatgtttgagacgaccatgagaggtgctaagaggatggccatcctaggcgatacagcttgggacttcgggagtctcggaggcgtgtttactagcattggtaaagccctgcaccaggtattcggggcaatatacggcgccgctttttccggagtctcttggaccatgaagatccttattggcgtgatcattacatggatcgggatgaatagccggtcaaccagtttgtccgttactctggtgctcgtcggaatagtgacgctgtatcttggcgtaatggtgcaggcgtga

SEQ ID NO: 1778 - RNA, 2043 nt, synthetic construct
  misc_feature 1..2043: note = derived and/or modified CDS sequence (opt3) from DENV-2 CYD2-T__SSopt-prME(S186F)
  source 1..2043: mol_type = other RNA
atgaagaggaaaaagagcgccggcatgatcattatgctgatacccaccgtgatggctttccacctcacaactagaaacggggagcctcatatgatcgtctcccggcaggaaaaaggaaagtctcttctgtttaaaacggaggacggtgttaatatgtgcaccttgatggcaatggatttaggcgaactgtgtgaggacacaattacttacaagtgcccactactccgccaaaacgaaccggaggatatcgactgttggtgcaattcaaccagtacatgggtgacctatgggacttgtacaaccatgggagagcaccgacgtgaaaagagaagcgtagccctggtgccccatgtcggcatgggtcttgagacgaggactgaaacctggatgtcctctgagggggcgtggaaacacgtgcagcggattgagacatggatcctgcgccatcctggattcactatgatggctgccatattggcatacaccatcggcacaacccactttcagagagccctcattttcatcctgctgacggctgttactccatcgatgacaatgaggtgcattggcatgtcaaaccgggattttgtggaaggggtcagcggaggtagttgggtggacatcgtactcgagcacggctcctgtgttaccactatggcaaagaataaacccacattagatttcgaactgataaagaccgaggccaaacagcctgctacgcttcgcaagtattgcattgaagccaagttgaccaacacaactaccgagtctcgatgtccaacacaaggggagcccagcctgaatgaggaacaggacaaaagatttgtgtgcaagcattccatggtcgataggggatggggcaacggttgtgggctattcggaaaaggcggcatcgtgacttgcgcgatgtttcggtgcaagaaaaatatggaagggaaggtggtccagcctgagaacctcgaatacaccattgttatcacaccacactcaggagaggagcatgcagtgggtaatgacaccggcaaacacgggaaggaaatcaagattactccgcagagtagcataacggaggccgaactgacaggatatggcaccgtaactatggagtgtttcccccgtaccggtcttgattttaacgaaatggtgctgttgcaaatggagaataaggcttggctcgtccaccgccagtggttcctggacttacctctgccatggctccccggggccgatacacagggctctaactggatccagaaggagacccttgtgacttttaaaaatcctcatgcaaagaaacaagacgttgtggtcctgggatcccaggaaggcgctatgcacacagccttgacgggggcgaccgagattcagatgtcaagcggaaacctactgttcactggtcatctcaagtgcagactgaggatggacaaacttcaactgaaaggcatgagttactctatgtgtacagggaagttcaaagtggtaaaggaaatcgccgagacccagcacggaacaatagttattcgggtgcagtatgagggcgatggttccccatgcaaaatcccctttgaaatcatggacttggagaagcgacatgtcctcgggcgcctgattactgtgaacccgatcgtcaccgaaaaggatagccctgtgaatattgaggcagaacccccattcggcgactcgtacataatcattggagttgagcctggccagttaaaactgaactggtttaagaaagggtcttccatcggacaaatgttcgagacgaccatgagaggtgctaagaggatggccatcctaggcgatacagcttgggactttgggtcactcggaggcgtgttcacttctattggtaaagccctgcaccaggtatttggggcaatatacggcgccgctttcagcggagtctcctggaccatgaagatccttattggcgtgatcattacatggatcgggatgaatagtcggagcacttcattgagtgttaccctggtgctcgtcggaatagtgacgctgtatcttggcgtaatggtgcaggcgtga

SEQ ID NO: 1779 - RNA, 2043 nt, synthetic construct
  misc_feature 1..2043: note = derived and/or modified CDS sequence (opt3) from DENV-2 CYD2-T__SSopt-prME(R188L)
  source 1..2043: mol_type = other RNA
atgaagaggaaaaagagcgccggcatgatcattatgctgatacccaccgtgatggctttccacctcacaactagaaacggggagcctcatatgatcgtctcccggcaggaaaaaggaaagtctcttctgtttaaaacggaggacggtgttaatatgtgcaccttgatggcaatggatttaggcgaactgtgtgaggacacaattacttacaagtgcccactactccgccaaaacgaaccggaggatatcgactgttggtgcaattcaaccagtacatgggtgacctatgggacttgtacaaccatgggagagcaccgacgtgaaaagagaagcgtagccctggtgccccatgtcggcatgggtcttgagacgaggactgaaacctggatgtcctctgagggggcgtggaaacacgtgcagcggattgagacatggatcctgcgccatcctggattcactatgatggctgccatattggcatacaccatcggcacaacccactttcagagagccctcattttcatcctgctgacggctgttactccatcgatgacaatgaggtgcattggcatgtcaaaccgggattttgtggaaggggtcagcggaggtagttgggtggacatcgtactcgagcacggctcctgtgttaccactatggcaaagaataaacccacattagatttcgaactgataaagaccgaggccaaacagcctgctacgcttcgcaagtattgcattgaagccaagttgaccaacacaactaccgagtctcgatgtccaacacaaggggagcccagcctgaatgaggaacaggacaaaagatttgtgtgcaagcattccatggtcgataggggatggggcaacggttgtgggctattcggaaaaggcggcatcgtgacttgcgcgatgtttcggtgcaagaaaaatatggaagggaaggtggtccagcctgagaacctcgaatacaccattgttatcacaccacactcaggagaggagcatgcagtgggtaatgacaccggcaaacacgggaaggaaatcaagattactccgcagagtagcataacggaggccgaactgacaggatatggcaccgtaactatggagtgttctccccttaccggtctggatttcaacgaaatggtgttgctccaaatggagaataaggcttggctggtccaccgtcagtggtttttagacctgcctctcccatggcttcccggggccgatacacagggctccaactggatccagaaagagaccctggtgactttcaaaaatcctcatgcaaagaaacaagacgttgtggtcttgggatcacaggaaggcgctatgcacacagccctaacgggggcgaccgagattcagatgagcagtggaaacctgctctttactggtcatctgaagtgccgccttagaatggacaagctgcaattgaaaggcatgtcttactccatgtgtacagggaagttcaaagtggtaaaggaaatcgccgagacccagcacggaacaatagttattagggtgcagtatgagggcgatggtagcccatgcaaaatccccttcgaaatcatggacctcgagaagcggcatgtcctggggcgattaattactgtgaacccgatcgtcaccgaaaaggattcgcctgtgaatattgaggcagaacccccatttggcgactcttacataatcattggagttgagcctggccagctgaaactaaactggttcaagaaagggtcctcaatcggacaaatgtttgagacgaccatgcgcggtgctaagagaatggccatcctcggcgatacagcttgggacttcgggagtctgggaggcgtgtttactagcattggtaaagcccttcaccaggtattcggggcaatatacggcgccgctttttccggagtctcttggaccatgaagatcttgattggcgtgatcattacatggatcgggatgaatagcaggtcaaccagtctgtccgttactctcgtgctggtcggaatagtgacgctttatctgggcgtaatggtgcaggcgtga

SEQ ID NO: 1780 - RNA, 2043 nt, synthetic construct
  misc_feature 1..2043: note = derived and/or modified CDS sequence (opt3) from DENV-2 CYD2-T__SSopt-pr(D104A)MEdelstem_TM,(F108S)-JEV
  source 1..2043: mol_type = other RNA
atgaagcgtaaaaagagcgccggcatgatcattatgctgatacccaccgtgatggctttccacctcacaactaggaacggggagcctcatatgatcgtctcccggcaggaaaaaggaaagtctcttctgtttaaaacggaggacggtgttaatatgtgcaccttgatggcaatggatttaggcgaactgtgtgaggacacaattacttacaagtgcccactactccgccaaaacgaaccggaggatatcgactgttggtgcaattcaaccagtacatgggtgacctatgggacttgtacaaccatgggagagcaccgacgtgccaagagaagcgtagcgctggtgccccatgtcggcatgggtcttgaaacgaggactgagacctggatgtcctctgaaggggcttggaaacacgtgcagcggattgagacatggatcctgcgccatcctggattcactatgatggccgcaatattggcctacaccatcggcacaacccactttcagagagctctcattttcatcctgctgacggcagttactccatcgatgacaatgaggtgcattggcatgtcaaaccgggattttgtggagggggtcagcggaggtagttgggtggacatcgtactcgaacacggctcctgtgttaccactatggccaagaataaacccacattagatttcgagctgataaagaccgaagctaaacagcctgccacgcttcgcaagtattgcattgaggcgaagttgaccaacacaactaccgaatctcgatgtccaacacaaggggagcccagcctgaatgaggaacaggacaaaagatttgtgtgcaagcattccatggtcgataggggatggggcaacggttgtgggctatcaggaaaaggcggcatcgtgacttgcgcaatgttccggtgcaagaaaaatatggaggggaaggtggtccagcctgaaaacctcgagtacaccattgttatcacaccacacagtggagaggaacatgccgtgggtaatgacaccggcaaacacgggaaggagatcaagattactccgcagagctctataacggaagctgagctgacaggatatggcaccgtaactatggaatgttcccccagaaccggtcttgattttaacgagatggtgctgttgcaaatggaaaataaagcctggctcgtccaccgccagtggttcctggacttacctctgccatggctccccggggcagatacacagggctcaaactggatccagaaggagacccttgtgacttttaaaaatcctcatgctaagaaacaagacgttgtggtcctgggaagccaggagggcgccatgcacacagcgttgacgggggccaccgaaattcagatgagttctggaaacctactgttcactggtcatctcaagtgcagactgaggatggacaaacttcaactgaagggcatgtcctacagcatgtgtacagggaagtttaaagtggtaaaggagatcgcagaaacccagcacggaacaatagttattcgggtgcagtatgagggcgatggttcgccatgcaaaatccccttcgagatcatggacttggaaaagcgacatgtcctcgggcgcctgattactgtgaacccgatcgtcaccgagaaggattctcctgtgaatattgaagctgagcccccattcggcgactcctacataatcattggagttgaacctggccagttaaaactgaactggtttaagaaagggtcaacgctaggaaaggccttcagtaccacactcaaaggtgctcaaagactggccgcacttggcgatactgcctgggactttgggagcatcggaggcgtgttcaattccatcggtagggctgtacaccaggtctttgggggcgcgttccggaccttgtttggaggcatgtcttggattacacaggggctgatgggagcactcctgctttggatgggcgtgaacgcccgcgatagaagcatagctctggccttcttggcaactggtggggttctcgtgtttctggccaccaatgtccacgcttga

SEQ ID NO: 1781 - RNA, 2043 nt, synthetic construct
  misc_feature 1..2043: note = derived and/or modified CDS sequence (opt3) from DENV-2 CYD2-T__SSopt-prMEdelstem_TM,(H261N)-JEV
  source 1..2043: mol_type = other RNA
atgaagaggaaaaagagcgccggcatgatcattatgctgatacccaccgtgatggctttccacctcacaactagaaacggggagcctcatatgatcgtctcccggcaggaaaaaggaaagtctcttctgtttaaaacggaggacggtgttaatatgtgcaccttgatggcaatggatttaggcgaactgtgtgaggacacaattacttacaagtgcccactactccgccaaaacgaaccggaggatatcgactgttggtgcaattcaaccagtacatgggtgacctatgggacttgtacaaccatgggagagcaccgacgtgaaaagagaagcgtagccctggtgccccatgtcggcatgggtcttgagacgaggactgaaacctggatgtcctctgagggggcgtggaaacacgtgcagcggattgagacatggatcctgcgccatcctggattcactatgatggctgccatattggcatacaccatcggcacaacccactttcagagagccctcattttcatcctgctgacggctgttactccatcgatgacaatgaggtgcattggcatgtcaaaccgggattttgtggaaggggtcagcggaggtagttgggtggacatcgtactcgagcacggctcctgtgttaccactatggcaaagaataaacccacattagatttcgaactgataaagaccgaggccaaacagcctgctacgcttcgcaagtattgcattgaagccaagttgaccaacacaactaccgagtctcgatgtccaacacaaggggagcccagcctgaatgaggaacaggacaaaagatttgtgtgcaagcattccatggtcgataggggatggggcaacggttgtgggctattcggaaaaggcggcatcgtgacttgcgcgatgtttcggtgcaagaaaaatatggaagggaaggtggtccagcctgagaacctcgaatacaccattgttatcacaccacactcaggagaggagcatgcagtgggtaatgacaccggcaaacacgggaaggaaatcaagattactccgcagagtagcataacggaggccgaactgacaggatatggcaccgtaactatggagtgttctccccgtaccggtcttgatttcaacgaaatggtgctgttgcaaatggagaataaggcttggctcgtccaccgccagtggtttctggacttacctctgccatggctccccggggccgatacacagggctccaactggatccagaaggagacccttgtgactttcaaaaatcctcatgcaaagaaacaagacgttgtggtcctgggatcacaggaaggcgctatgaacacagccttgacgggggcgaccgagattcagatgagcagtggaaacctactgtttactggtcacctcaagtgcagactgaggatggacaaacttcaactgaaaggcatgtcttactccatgtgtacagggaagttcaaagtggtaaaggaaatcgccgagacccagcatggaacaatagttattcgggtgcagtatgagggcgatggtagcccatgcaaaatccccttcgaaatcatggacttggagaagcgacacgtcctcgggcgcctgattactgtgaatccgatcgtcaccgaaaaggattcgcctgtgaacattgaggcagaacccccatttggcgactcttacataatcattggagttgagcctggccagttaaaactgaattggttcaagaaagggtccacgctaggaaaggctttttcaaccacactcaaaggtgcccaaagactggctgcccttggcgatactgcatgggacttcgggagtatcggaggcgtgtttaacagcatcggtagggccgtacatcaggtcttcgggggcgcttttcggaccttgttcggaggcatgtcctggattacacaggggctgatgggagcgctcctgctttggatgggcgtgaatgcacgcgatagatctatagccctggcctttttggctactggtggggttctcgtgttcctggcaaccaacgtccacgcctga

SEQ ID NO: 1782 - RNA, 2043 nt, synthetic construct
  misc_feature 1..2043: note = derived and/or modified CDS sequence (opt3) from DENV-2 CYD2-T__SSopt-prMEdelstem_TM,(R188L,A267T)-JEV
  source 1..2043: mol_type = other RNA
atgaagaggaaaaagagcgccggcatgatcattatgctgatacccaccgtgatggctttccacctcacaactagaaacggggagcctcatatgatcgtctcccggcaggaaaaaggaaagtctcttctgtttaaaacggaggacggtgttaatatgtgcaccttgatggcaatggatttaggcgaactgtgtgaggacacaattacttacaagtgcccactactccgccaaaacgaaccggaggatatcgactgttggtgcaattcaaccagtacatgggtgacctatgggacttgtacaaccatgggagagcaccgacgtgaaaagagaagcgtagccctggtgccccatgtcggcatgggtcttgagacgaggactgaaacctggatgtcctctgagggggcgtggaaacacgtgcagcggattgagacatggatcctgcgccatcctggattcactatgatggctgccatattggcatacaccatcggcacaacccactttcagagagccctcattttcatcctgctgacggctgttactccatcgatgacaatgaggtgcattggcatgtcaaaccgggattttgtggaaggggtcagcggaggtagttgggtggacatcgtactcgagcacggctcctgtgttaccactatggcaaagaataaacccacattagatttcgaactgataaagaccgaggccaaacagcctgctacgcttcgcaagtattgcattgaagccaagttgaccaacacaactaccgagtctcgatgtccaacacaaggggagcccagcctgaatgaggaacaggacaaaagatttgtgtgcaagcattccatggtcgataggggatggggcaacggttgtgggctattcggaaaaggcggcatcgtgacttgcgcgatgtttcggtgcaagaaaaatatggaagggaaggtggtccagcctgagaacctcgaatacaccattgttatcacaccacactcaggagaggagcatgcagtgggtaatgacaccggcaaacacgggaaggaaatcaagattactccgcagagtagcataacggaggccgaactgacaggatatggcaccgtaactatggagtgttctccccttaccggtctggatttcaacgaaatggtgttgctccaaatggagaataaggcttggctggtccaccgtcagtggtttttagacctgcctctcccatggcttcccggggccgatacacagggctccaactggatccagaaagagaccctggtgactttcaaaaatcctcatgcaaagaaacaagacgttgtggtcttgggatcacaggaaggcgctatgcacacagccctaacggggaccactgagattcagatgagcagtggaaacctgctctttacaggtcatctgaagtgccgccttagaatggacaagctgcaattgaaaggcatgtcttactccatgtgtaccgggaagttcaaagtggtaaaggaaatcgcggagacacagcacggaactatagttattagggtgcagtatgagggcgatggtagcccatgcaaaatccccttcgaaatcatggacctcgagaagcggcatgtcctggggcgattaattaccgtgaacccgatcgtcacggaaaaggattcgcctgtgaatattgaggccgaacccccatttggcgactcttacataatcattggagttgagcctggccagctgaaactaaactggttcaagaaagggtccaccctcggaaaggcattttcaacaactctgaaaggtgctcaacgccttgccgctttgggcgataccgcctgggacttcgggagtatcggaggcgtgtttaatagcatcggtagagcagtacaccaggtcttcgggggcgcctttaggacactgttcggaggcatgtcctggattactcaggggctcatgggagctctgcttctgtggatgggcgtgaacgcgcgggatcgctctatagcattggcctttctcgctaccggtggggttctggtgttcttagccacgaatgtccacgcatga

SEQ ID NO: 1783 - RNA, 297 nt, synthetic construct
  misc_feature 1..297: note = derived and/or modified CDS sequence (opt3) from DENV-4 Consensus__C
  source 1..297: mol_type = other RNA
atgaaccagagaaagaaagtggtcaggccccctttcaatatgctgaagcgggagcgcaaccgagttagcaccccacaaggcctcgtgaaacgtttttccacagggcttttctctggaaagggtccgctgagaatggtattggcctttatcactttcttaagggtgctgtcaattccccctacggctggcatactaaaacggtgggggcagctcaagaagaataaagcaatcaagattctgatcggatttcgcaaagaaattggcagaatgcttaacatcctgaatggtaggaagcgg

SEQ ID NO: 1784 - RNA, 339 nt, synthetic construct
  misc_feature 1..339: note = derived and/or modified CDS sequence (opt3) from DENV-4 Consensus__C-SSc
  source 1..339: mol_type = other RNA
atgaaccagagaaagaaagtggtcaggccccctttcaatatgctgaagcgggagcgcaaccgagttagcaccccacaaggcctcgtgaaacgtttttccacagggcttttctctggaaagggtccgctgagaatggtattggcctttatcactttcttaagggtgctgtcaattccccctacggctggcatactaaaacggtgggggcagctcaagaagaataaagcaatcaagattctgatcggatttcgcaaagaaattggcagaatgcttaacatcctgaatggtaggaagcggagtaccataacattgctctgcctgatcccaactgtcatggcc

SEQ ID NO: 1785 - RNA, 273 nt, synthetic construct
  misc_feature 1..273: note = derived and/or modified CDS sequence (opt3) from DENV-4 Consensus__pr
  source 1..273: mol_type = other RNA
ttccacctgagcaccagagacggcgagcccctcatgatcgtggccaagcatgaaagggggcggcctcttctgtttaaaacaactgagggaattaacaagtgcacgttgatagctatggatttaggtgaaatgtgtgaggacaccgtcacatacaaatgcccactgctagttaatactgaaccggaggatatcgactgttggtgcaacctcacctccacatgggtgatgtatggcacctgtactcagtctggggagcgccgacgtgaaaagaga

SEQ ID NO: 1786 - RNA, 225 nt, synthetic construct
  misc_feature 1..225: note = derived and/or modified CDS sequence (opt3) from DENV-4 Consensus__M
  source 1..225: mol_type = other RNA
agcgtggccctgacaccccactccggcatggggctcgagaccagagctgaaacttggatgtcttcagagggagcatggaagcatgcccagagggtcgaaagttggatccttcggaaccctggtttcgcgctgttggctggctttatggcctacatgattgggcaaacgggaatacagcgcaccgttttctttgtgttaatgatgctggtagcaccaagctatggc

SEQ ID NO: 1787 - RNA, 498 nt, synthetic construct
  misc_feature 1..498: note = derived and/or modified CDS sequence (opt3) from DENV-4 Consensus__prM
  source 1..498: mol_type = other RNA
ttccacctgagcaccagagacggcgagcccctcatgatcgtggccaagcatgaaagggggcggcctcttctgtttaaaacaactgagggaattaacaagtgcacgttgatagctatggatttaggtgaaatgtgtgaggacaccgtcacatacaaatgcccactgctagttaatactgaaccggaggatatcgactgttggtgcaacctcacctccacatgggtgatgtatggcacctgtactcagtctggggagcgccgacgtgaaaagagatcagtagcactgacaccccacagtggaatgggccttgagaccagggccgaaacgtggatgagctccgagggtgcgtggaaacatgctcaacgggtggagtcttggattctgcgcaatcctgggttcgccttgctcgcaggatttatggcctacatgatcggccagactggcattcagagaaccgtcttctttgtgctgatgatgctggttgctccatcgtatggg

SEQ ID NO: 1788 - RNA, 1485 nt, synthetic construct
  misc_feature 1..1485: note = derived and/or modified CDS sequence (opt3) from DENV-4 Consensus__E
  source 1..1485: mol_type = other RNA
atgagatgcgtgggcgtcgggaacagggacttcgttgagggagtgagcggtggcgcctgggtagatctggtgctcgaacacgggggatgtgtcaccacaatggctcagggcaagcccactcttgactttgagctgacgaaaaccacagcaaaggaagtggccttgttacggacttactgcatcgaggcgtccatttctaatataaccacagctacccgctgtcctactcaaggtgaaccatatctgaaagaggagcaggatcagcagtacatctgccgacgtgacgttgtggatagagggtggggaaacggctgtggcctattcgggaagggaggtgtcgtgacatgcgccaaattttcatgtagtggcaagattaccgggaatctcgtacaaatcgaaaacctggagtatacggttgtggtcactgtgcataatggagacacccacgcagtgggcaacgatacaagcaatcatggtgtcactgccaccattacaccgaggtccccctctgttgaagtgaaacttcctgactacggggagctgaccttggattgcgagccacggtcgggaatcgacttcaacgaaatgatactcatgaagatgaagaaaaagacgtggctggtacacaaacagtggtttctggatctccccttaccttggactgctggcgcagacacatcagaggtgcattggaattataaggaacgcatggtcaccttcaaggtgccacacgccaaaagacaggatgttactgtgctgggcagccaggagggggctatgcacagtgcccttgcgggagcaacagaagtcgactccggtgacggcaaccatatgtttgccgggcacttgaagtgtaaagtgaggatggagaagctgcggatcaaaggaatgtcttacaccatgtgcagcggcaagttctccattgataaagagatggctgaaacgcaacatggtaccacagtagttaaggtgaagtatgagggggccggcgcaccctgtaaagtccctatcgaaattcgcgacgtgaataaggagaaagtcgtgggacgagttatctcaagtactccactagctgaaaacaccaatagcgtgacaaacatagagctcgagccgccctttggcgattcttacattgtaatcggggtcggaaattccgccctgactcttcactggttcagaaagggttcaagcattggcaaaatgtttgaaagtacctacaggggagcgaagcggatggccatcctgggggagacagcatgggacttcggctctgtgggtgggttgtttacctccctcggcaaggctgttcaccaggtgttcggaagcgtctatactacgatgttcggcggggtgtcgtggatgatccgtattctgataggatttttagtactgtggatcggtacaaactctcgcaacacctccatggccatgacttgcattgctgtgggcgggatcaccctcttccttggatttacagttcaggcc

SEQ ID NO: 1789 - RNA, 1983 nt, synthetic construct
  misc_feature 1..1983: note = derived and/or modified CDS sequence (opt3) from DENV-4 Consensus__prME
  source 1..1983: mol_type = other RNA
ttccacctgagcaccagagacggcgagcccctcatgatcgtggccaagcatgaaagggggcggcctcttctgtttaaaacaactgagggaattaacaagtgcacgttgatagctatggatttaggtgaaatgtgtgaggacaccgtcacatacaaatgcccactgctagttaatactgaaccggaggatatcgactgttggtgcaacctcacctccacatgggtgatgtatggcacctgtactcagtctggggagcgccgacgtgaaaagagatcagtagcactgacaccccacagtggaatgggccttgagaccagggccgaaacgtggatgagctccgagggtgcgtggaaacatgctcaacgggtggagtcttggattctgcgcaatcctgggttcgccttgctcgcaggatttatggcctacatgatcggccagactggcattcagagaaccgtcttctttgtgctgatgatgctggttgctccatcgtatgggatgaggtgcgtgggagtcggtaaccgggatttcgtggaaggcgtatcagggggagcatgggttgacctcgtgttagagcacggcggttgtgtcacaactatggcccaggggaagcccaccctggattttgaacttacaaagaccacggctaaagaggtggccttgctgcgcacttactgcatcgaagcgagcataagtaatatcacaaccgcaactcgatgtcctacacaaggagagccatatctaaaggaggaacaggaccagcagtacatttgcagaagggatgtggtcgaccggggctggggcaacgggtgtggactcttcggtaaaggcggggttgtgacctgcgccaagttttcctgctctggaaaaatcacgggcaatctggtacaaattgagaaccttgaatataccgtggtcgtgacagttcataatggtgatactcacgctgtggggaacgacaccagcaatcacggcgtcacagccactatcacaccccgttccccttcagtggaggtaaagctgccagattacggagaattgaccctcgactgtgagccgcgcagtggcatagacttcaacgagatgattctgatgaagatgaaaaagaaaacctggttagttcataagcagtggtttctggatctcccccttccttggactgcaggggctgacacgagcgaagtgcactggaattacaaagagagaatggtcacattcaaggtgccacatgccaaaaggcaggatgtcaccgtgctgggatctcaggaaggtgcgatgcactccgccttggcaggcgctactgaggttgactcaggggatggaaaccacatgtttgccggccatctaaagtgcaaggtgcggatggaaaaactgcgaatcaagggtatgagctataccatgtgtagtgggaaattctctattgacaaggagatggctgagacacaacacggcaccactgtagtcaaagtgaagtacgaaggagccggcgcaccctgcaaggttcctatcgagatccgcgatgtgaataaagaaaaggtcgtggggagagtaatttccagcacaccactcgccgagaacacgaactcggtgaccaatatagagctggaacccccgttcggagactcttatatcgttattggtgtcggcaactccgctcttactctgcattggtttaggaaagggtcaagtatcggaaagatgttcgagagcacataccggggcgcgaaacgcatggcaatattgggtgaaaccgcctgggattttgggtccgtgggcggactcttcacatctctgggcaaggctgtgcaccaggtctttgggagcgtttatactaccatgttcggaggcgtgtcatggatgattagaatcttaatcggttttctggtgctatggattgggacgaatagtaggaacacctccatggccatgacatgtatcgcagtaggaggcattactctcttcctgggttttaccgtccaggcc

SEQ ID NO: 1790 - RNA, 2025 nt, synthetic construct
  misc_feature 1..2025: note = derived and/or modified CDS sequence (opt3) from DENV-4 Consensus__SSc-prME
  source 1..2025: mol_type = other RNA
agcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatgggacctgcacgcagtcaggcgagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggct

SEQ ID NO: 1791 - RNA, 2322 nt, synthetic construct
  misc_feature 1..2322: note = derived and/or modified CDS sequence (opt3) from DENV-4 Consensus__C-prME
  source 1..2322: mol_type = other RNA
atgaaccagagaaagaaagtggtcaggccccctttcaatatgctgaagcgggagcgcaaccgagttagcaccccacaaggcctcgtgaaacgtttttccacagggcttttctctggaaagggtccgctgagaatggtattggcctttatcactttcttaagggtgctgtcaattccccctacggctggcatactaaaacggtgggggcagctcaagaagaataaagcaatcaagattctgatcggatttcgcaaagaaattggcagaatgcttaacatcctgaatggtaggaagcggagtaccataacattgctctgcctgatcccaactgtcatggccttccacctgagcacccgcgacggggagcccctcatgattgtggcgaaacatgaacgaggaagacctttactgtttaagacaaccgagggcatcaacaagtgtactcttattgctatggatttgggcgaaatgtgcgaggacacagttacctacaaatgtccactgctagtgaatacggagcccgaagatatcgactgctggtgtaacctcacttccacctgggtcatgtatgggacatgcactcagtctggagagaggcggcgtgaaaagcgctcggtggccctgacccctcactcaggtatgggccttgagacaagagcagagacctggatgagcagtgaaggggcctggaaacatgctcagagggtagagtcctggatactgcggaatccaggattcgcattgctcgccggctttatggcttacatgattggtcaaacggggatccagcgaactgttttctttgtgctgatgatgttagtcgccccgtcttatggaatgcgctgtgtgggcgtgggcaacagagatttcgtcgaaggggttagcggaggtgcgtgggtggacctggtactcgagcacggcgggtgcgtgacaaccatggcacagggaaagcccactcttgattttgaactgacaaaaaccacggccaaggaggtcgctttgctaaggacctactgtattgaggcctccatctcaaatatcacaactgcaacccggtgccctacacagggcgaaccatatctgaaagaggaacaagaccagcagtacatttgtcgcagagatgtggttgacaggggttgggggaacggctgcggactcttcggcaaagggggagtggtcacttgcgctaagttcagttgtagcggtaagataaccggcaatctggtgcagatcgagaaccttgaatatacagtagttgtgaccgtccataatggggatactcacgccgtgggaaacgacacgtctaaccacggcgtcacagcgaccattactccccgttccccttcagtggaggttaagctgccagattacggtgagttgaccctcgactgcgaaccccggagcgggatcgactttaatgagatgatactgatgaaaatgaagaaaaagacatggttagtgcataagcaatggttcctggatctaccgctcccttggaccgccggcgcagacacaagtgaagtacactggaactacaaagagcgaatggtcacttttaaggtgccccatgctaaaagacaggatgttacggtgctgggatctcaggaaggcgccatgcactccgctcttgccggggcaaccgaggtcgacagcggagatggtaatcacatgttcgccggccatttgaagtgtaaagtgaggatggagaagctgcgcattaaggggatgtcgtatactatgtgctctggaaaattttccatcgacaaggaaatggctgagacacaacacggcaccacagtagtgaaagttaagtacgaaggtgcgggggcaccatgtaaagtccctatcgagattcgggatgtgaacaaggagaaggtggtcggcagagttatctcaagtactcccctcgccgaaaataccaacagcgtgacgaatattgagctggaaccacccttcggagactcctatatagtgatcggcgtagggaactctgctcttaccctgcattggtttaggaaaggaagctcaattggcaagatgttcgagagtacataccgcggtgccaaacgaatggcaatcttgggggaaactgcctgggattttggatccgtcggcggtctcttcaccagcctgggcaaggctgtgcaccaggtttttgggtctgtgtatacaactatgttcggaggcgtctcatggatgatccggattttaatagggtttctggtgctatggatcggaaccaatagtcgtaacacgagcatggccatgacatgcattgcagttggcggtatcaccctcttcctggggttcactgtgcaggcg

SEQ ID NO: 1792 - RNA, 45 nt, synthetic construct
  misc_feature 1..45: note = derived and/or modified CDS sequence (opt3) from DENV-4 Consensus__SSc
  source 1..45: mol_type = other RNA
atgagcaccatcacactgctctgccttattcccactgtgatggcc

SEQ ID NO: 1793 - RNA, 57 nt, synthetic construct
  misc_feature 1..57: note = derived and/or modified CDS sequence (opt3) from DENV-4 Consensus__SSopt
  source 1..57: mol_type = other RNA
atgaagagaaagaaaagcaccatcacactgctctgccttattcccactgtgatggcc

SEQ ID NO: 1794 - RNA, 57 nt, synthetic construct
  misc_feature 1..57: note = derived and/or modified CDS sequence (opt3) from DENV-4 Consensus__SSm
  source 1..57: mol_type = other RNA
atgatccagagaaccgtgttctttgtcctgatgatgctcgttgcccccagctacggc

SEQ ID NO: 1795 - RNA, 1488 nt, synthetic construct
  misc_feature 1..1488: note = derived and/or modified CDS sequence (opt3) from DENV-4 Consensus__E
  source 1..1488: mol_type = other RNA
atgagatgcgtgggcgtcgggaacagggacttcgttgagggagtgagcggtggcgcctgggtagatctggtgctcgaacacgggggatgtgtcaccacaatggctcagggcaagcccactcttgactttgagctgacgaaaaccacagcaaaggaagtggccttgttacggacttactgcatcgaggcgtccatttctaatataaccacagctacccgctgtcctactcaaggtgaaccatatctgaaagaggagcaggatcagcagtacatctgccgacgtgacgttgtggatagagggtggggaaacggctgtggcctattcgggaagggaggtgtcgtgacatgcgccaaattttcatgtagtggcaagattaccgggaatctcgtacaaatcgaaaacctggagtatacggttgtggtcactgtgcataatggagacacccacgcagtgggcaacgatacaagcaatcatggtgtcactgccaccattacaccgaggtccccctctgttgaagtgaaacttcctgactacggggagctgaccttggattgcgagccacggtcgggaatcgacttcaacgaaatgatactcatgaagatgaagaaaaagacgtggctggtacacaaacagtggtttctggatctccccttaccttggactgctggcgcagacacatcagaggtgcattggaattataaggaacgcatggtcaccttcaaggtgccacacgccaaaagacaggatgttactgtgctgggcagccaggagggggctatgcacagtgcccttgcgggagcaacagaagtcgactccggtgacggcaaccatatgtttgccgggcacttgaagtgtaaagtgaggatggagaagctgcggatcaaaggaatgtcttacaccatgtgcagcggcaagttctccattgataaagagatggctgaaacgcaacatggtaccacagtagttaaggtgaagtatgagggggccggcgcaccctgtaaagtccctatcgaaattcgcgacgtgaataaggagaaagtcgtgggacgagttatctcaagtactccactagctgaaaacaccaatagcgtgacaaacatagagctcgagccgccctttggcgattcttacattgtaatcggggtcggaaattccgccctgactcttcactggttcagaaagggttcaagcattggcaaaatgtttgaaagtacctacaggggagcgaagcggatggccatcctgggggagacagcatgggacttcggctctgtgggtgggttgtttacctccctcggcaaggctgttcaccaggtgttcggaagcgtctatactacgatgttcggcggggtgtcgtggatgatccgtattctgataggatttttagtactgtggatcggtacaaactctcgcaacacctccatggccatgacttgcattgctgtgggcgggatcaccctcttccttggatttacagttcaggcctga

SEQ ID NO: 1796 - RNA, 1182 nt, synthetic construct
  misc_feature 1..1182: note = derived and/or modified CDS sequence (opt3) from DENV-4 Consensus__EdelTM-variant (aa1-394)
  source 1..1182: mol_type = other RNA
atgagatgcgtgggcgtcgggaacagggacttcgttgagggagtgagcggtggcgcctgggtagatctggtgctcgaacacgggggatgtgtcaccacaatggctcagggcaagcccactcttgactttgagctgacgaaaaccacagcaaaggaagtggccttgttacggacttactgcatcgaggcgtccatttctaatataaccacagctacccgctgtcctactcaaggtgaaccatatctgaaagaggagcaggatcagcagtacatctgccgacgtgacgttgtggatagagggtggggaaacggctgtggcctattcgggaagggaggtgtcgtgacatgcgccaaattttcatgtagtggcaagattaccgggaatctcgtacaaatcgaaaacctggagtatacggttgtggtcactgtgcataatggagacacccacgcagtgggcaacgatacaagcaatcatggtgtcactgccaccattacaccgaggtccccctctgttgaagtgaaacttcctgactacggggagctgaccttggattgcgagccacggtcgggaatcgacttcaacgaaatgatactcatgaagatgaagaaaaagacgtggctggtacacaaacagtggtttctggatctccccttaccttggactgctggcgcagacacatcagaggtgcattggaattataaggaacgcatggtcaccttcaaggtgccacacgccaaaagacaggatgttactgtgctgggcagccaggagggggctatgcacagtgcccttgcgggagcaacagaagtcgactccggtgacggcaaccatatgtttgccgggcacttgaagtgtaaagtgaggatggagaagctgcggatcaaaggaatgtcttacaccatgtgcagcggcaagttctccattgataaagagatggctgaaacgcaacatggtaccacagtagttaaggtgaagtatgagggggccggcgcaccctgtaaagtccctatcgaaattcgcgacgtgaataaggagaaagtcgtgggacgagttatctcaagtactccactagctgaaaacaccaatagcgtgacaaacatagagctcgagccgccctttggcgattcttacattgtaatcggggtcggaaattccgccctgactcttcactggttcagaaag

SEQ ID NO: 1797 - RNA, 1272 nt, synthetic construct
  misc_feature 1..1272: note = derived and/or modified CDS sequence (opt3) from DENV-4 Consensus__EdelTM-variant (aa1-424)
  source 1..1272: mol_type = other RNA
atgagatgcgtgggcgtcgggaacagggacttcgttgagggagtgagcggtggcgcctgggtagatctggtgctcgaacacgggggatgtgtcaccacaatggctcagggcaagcccactcttgactttgagctgacgaaaaccacagcaaaggaagtggccttgttacggacttactgcatcgaggcgtccatttctaatataaccacagctacccgctgtcctactcaaggtgaaccatatctgaaagaggagcaggatcagcagtacatctgccgacgtgacgttgtggatagagggtggggaaacggctgtggcctattcgggaagggaggtgtcgtgacatgcgccaaattttcatgtagtggcaagattaccgggaatctcgtacaaatcgaaaacctggagtatacggttgtggtcactgtgcataatggagacacccacgcagtgggcaacgatacaagcaatcatggtgtcactgccaccattacaccgaggtccccctctgttgaagtgaaacttcctgactacggggagctgaccttggattgcgagccacggtcgggaatcgacttcaacgaaatgatactcatgaagatgaagaaaaagacgtggctggtacacaaacagtggtttctggatctccccttaccttggactgctggcgcagacacatcagaggtgcattggaattataaggaacgcatggtcaccttcaaggtgccacacgccaaaagacaggatgttactgtgctgggcagccaggagggggctatgcacagtgcccttgcgggagcaacagaagtcgactccggtgacggcaaccatatgtttgccgggcacttgaagtgtaaagtgaggatggagaagctgcggatcaaaggaatgtcttacaccatgtgcagcggcaagttctccattgataaagagatggctgaaacgcaacatggtaccacagtagttaaggtgaagtatgagggggccggcgcaccctgtaaagtccctatcgaaattcgcgacgtgaataaggagaaagtcgtgggacgagttatctcaagtactccactagctgaaaacaccaatagcgtgacaaacatagagctcgagccgccctttggcgattcttacattgtaatcggggtcggaaattccgccctgactcttcactggttcagaaagggttcaagcattggcaaaatgtttgaaagtacctacaggggagcgaagcggatggccatcctgggggagacagcatgggacttcggctct

SEQ ID NO: 1798 - RNA, 1266 nt, synthetic construct
  misc_feature 1..1266: note = derived and/or modified CDS sequence (opt3) from DENV-4 Consensus__EdelTM-variant (aa1-421)
  source 1..1266: mol_type = other RNA
atgagatgcgtgggcgtcgggaacagggacttcgttgagggagtgagcggtggcgcctgggtagatctggtgctcgaacacgggggatgtgtcaccacaatggctcagggcaagcccactcttgactttgagctgacgaaaaccacagcaaaggaagtggccttgttacggacttactgcatcgaggcgtccatttctaatataaccacagctacccgctgtcctactcaaggtgaaccatatctgaaagaggagcaggatcagcagtacatctgccgacgtgacgttgtggatagagggtggggaaacggctgtggcctattcgggaagggaggtgtcgtgacatgcgccaaattttcatgtagtggcaagattaccgggaatctcgtacaaatcgaaaacctggagtatacggttgtggtcactgtgcataatggagacacccacgcagtgggcaacgatacaagcaatcatggtgtcactgccaccattacaccgaggtccccctctgttgaagtgaaacttcctgactacggggagctgaccttggattgcgagccacggtcgggaatcgacttcaacgaaatgatactcatgaagatgaagaaaaagacgtggctggtacacaaacagtggtttctggatctccccttaccttggactgctggcgcagacacatcagaggtgcattggaattataaggaacgcatggtcaccttcaaggtgccacacgccaaaagacaggatgttactgtgctgggcagccaggagggggctatgcacagtgcccttgcgggagcaacagaagtcgactccggtgacggcaaccatatgtttgccgggcacttgaagtgtaaagtgaggatggagaagctgcggatcaaaggaatgtcttacaccatgtgcagcggcaagttctccattgataaagagatggctgaaacgcaacatggtaccacagtagttaaggtgaagtatgagggggccggcgcaccctgtaaagtccctatcgaaattcgcgacgtgaataaggagaaagtcgtgggacgagttatctcaagtactccactagctgaaaacaccaatagcgtgacaaacatagagctcgagccgccctttggcgattcttacattgtaatcggggtcggaaattccgccctgactcttcactggttcagaaagggttcaagcattggcaaaatgtttgaaagtacctacaggggagcgaagcggatggccatcctgggggagacagcatgggactga

SEQ ID NO: 1799 - RNA, 2031 nt, synthetic construct
  misc_feature 1..2031: note = derived and/or modified CDS sequence (opt3) from DENV-4 Consensus__SSc-prME
  source 1..2031: mol_type = other RNA
atgagcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatgggacctgcacgcagtcaggcgagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtagcattggaaagatgttcgagtccacttaccggggcgcaaaacgcatggccatcttaggtgaaaccgcttgggattttgggtctgtgggcggactgttcacgagcctaggcaaggccgtccaccaggtttttgggtcagtgtataccacaatgttcggaggcgtgagttggatgatcaggattctcatcggttttctggtactttggattgggactaattccagaaacaccagcatggcaatgacatgcatagccgtcggaggcatcactttgttcctgggttttaccgtgcaggcttga

SEQ ID NO: 1800 - RNA, 2031 nt, synthetic construct
  misc_feature 1..2031: note = derived and/or modified CDS sequence (opt3) from DENV-4 Consensus__SSc-prME(F108S)
  source 1..2031: mol_type = other RNA
atgagcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatgggacctgcacgcagtcaggcgagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgtctggtaaaggcggggtggtaacatgcgctaagttcagctgttccggaaaaatcactggcaatttggtgcaaatagagaacctcgaatataccgtcgtggttacagtgcataatggtgatactcacgccgtcgggaacgacacctcaaatcacggcgtgacagcaaccattactcctcgtagtccaagcgtagaggttaagctgccggattacggagaattaacgctggactgcgagccccgctctggcatcgactttaacgagatgattctcatgaagatgaaaaagaaaacatggcttgtgcataagcagtggttcctggatttgcctctaccatggaccgctggggccgacacttccgaagtccactggaattacaaagagagaatggtgacctttaaggtcccccatgcgaaaaggcaggatgtgacagttctgggatcacaggaaggtgccatgcacagcgcactcgctggcgccaccgaggtggacagtggggatggaaaccacatgttcgctggccatctgaagtgtaaggtacggatggaaaaacttcgaatcaagggtatgtcttatactatgtgctccgggaaatttagcatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatctcgtctactcccctggctgagaacacaaactccgttaccaatattgagttggaaccgcctttcggagactcatatatcgtcataggtgtgggcaacagtgcgctcacactgcattggttcaggaaagggagctccattggaaagatgtttgagtctacttaccggggcgcaaaacgcatggccatcttaggtgaaaccgcttgggatttcgggagcgtgggcggactgtttacgtcactaggcaaggccgtccaccaggttttcgggagtgtgtataccacaatgtttggaggcgtgtcctggatgatcaggattctcatcggtttcctggtactttggattgggactaatagcagaaacacctctatggcaatgacatgcatagccgtcggaggcatcactttgtttctgggtttcaccgtgcaggcttga

SEQ ID NO: 1801 - RNA, 2031 nt, synthetic construct
  misc_feature 1..2031: note = derived and/or modified CDS sequence (opt3) from DENV-4 Consensus__SSc-prMEdelstem_TM-JEV
  source 1..2031: mol_type = other RNA
atgagcaccatcacactgctctgccttattcccactgtgatggccttccacctgtccacgagagacggcgagcctttgatgatagtcgctaagcatgaaagggggcggccattactgtttaaaaccacagagggaatcaacaagtgtactctaattgcaatggatctcggtgaaatgtgcgaggacaccgttacatacaaatgtccgctgcttgtgaataccgaacccgaggatatcgactgctggtgtaacctgacttctacatgggtaatgtatgggacctgcacgcagtcaggcgagcgccgacgtgaaaagagaagtgtggccttgactcctcacagcggaatgggcctcgagaccagggcggaaacatggatgtcctctgagggtgcttggaaacatgcccaacgggtcgagtcgtggattctgcgcaatccagggttcgcactgctcgccggatttatggcttacatgatcggccagactggcatacagagaaccgtgttctttgttttaatgatgctggtggcaccctcatatgggatgaggtgtgtcggagtgggtaaccgggatttcgtagaaggcgttagcgggggagcctgggtggaccttgtcttggagcacggcggttgcgtgacaaccatggctcaggggaagcctacgctggattttgaactaactaagacaaccgccaaagaggtggcgctcctgcgcacttactgtatcgaagcaagtatttccaatatcacaaccgccacgcgatgcccaacccaaggagagccctatcttaaggaggaacaggaccagcagtacatttgtagaagggatgtcgttgaccggggctggggcaacgggtgcggactgttcggtaaaggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgttcaccaagtgtagaggttaagctgccggattacggagaattaacgctggactgcgagccccgcagcggcatcgacttcaacgagatgattctcatgaagatgaaaaagaaaacatggcttgtgcataagcagtggtttctggatttgcctctaccatggaccgctggggccgacacttctgaagtccactggaattacaaagagagaatggtgaccttcaaggtcccccatgcgaaaaggcaggatgtgacagttctgggatcccaggaaggtgccatgcactcagcactcgctggcgccaccgaggtggacagcggggatggaaaccacatgtttgctggccatctgaagtgtaaggtacggatggaaaaacttcgaatcaagggtatgagttatactatgtgctctgggaaattctccatcgacaaggagatggccgagacacaacacggcacgaccgtcgtgaaagttaagtacgaaggagcaggcgccccttgtaaggtgccaattgagatacgcgatgtcaataaagaaaaggtggtagggagagtgatcagctcgactcccctggctgagaacacaaactctgttaccaatattgagttggaaccgcctttcggagactcctatatcgtcataggtgtgggcaactcagcgctcacactgcattggtttaggaaagggagtactttaggaaaggcattcagcaccacgctgaaaggcgcccagcggctagctgccctcggtgataccgcatgggactttgggtccattggcggagtgttcaattctatcggccgcgccgtccaccaggtttttgggggagctttcagaacactgtttggcggtatgagctggatcactcaagggcttatgggagccttgctgctctggatgggcgtgaacgcaagggatcgttcaattgcgctggctttccttgccaccggtggcgtgctggtatttttggcaacaaatgtccatgcctga

SEQ ID NO: 1802 - RNA, 1332 nt, synthetic construct
  misc_feature 1..1332: note = derived and/or modified CDS sequence (opt3) from DENV-4 Consensus__SSm-EdelTM
  source 1..1332: mol_type = other RNA
atgatccagagaaccgtgttctttgtcctgatgatgctcgttgcccccagctacggcatgaggtgcgtgggggtaggaaaccgggacttcgtggagggtgtctccggcggggcttgggtggatcttgttctggaacacggaggctgtgtgacaactatggcacaaggtaagcctacgttggactttgagttaaccaaaacaactgccaaggaagtcgcgctgctacgcacctattgcattgaggcttctatatcaaatatcacaaccgccactcgatgtccaacacagggggaaccgtacctcaaagaggagcaggatcagcaatatatttgccgtagagacgtggtagataggggatggggcaacggctgtgggctgttcggaaagggtggcgttgtgacctgcgcaaaatttagttgtagcgggaagatcacgggaaatcttgtccagattgaaaacctggagtacactgtggtggtcaccgttcataatggcgacacacacgccgtgggtaacgatacttccaatcatggggtaaccgctacaatcacgccccggtctccttcggtggaagtcaagttgccagactatggagagctcaccctggattgcgagccccgctcaggcatagacttcaacgaaatgatcctgatgaaaatgaagaaaaagacttggctcgtgcacaaacagtggtttttagatctgcctcttccatggacagcaggcgccgacaccagcgaggttcattggaattacaaggaaagaatggtgactttcaaggtcccccacgctaaaaggcaggatgtgacagtattggggagtcaagagggagccatgcactccgcgctggccggtgcaaccgaagttgactctggcgacgggaaccatatgtttgctggacacctaaagtgtaaagtgcggatggagaagctccgcattaaaggcatgagctatacgatgtgctccggtaagttctcaatcgataaagagatggccgaaacccagcatgggacaactgtcgtgaaggtcaagtacgagggcgcaggagctccttgtaaagtgccaattgaaatccgagacgttaataaggagaaagtggtaggcagagtcataagtagcaccccgctggccgaaaacacaaattctgtgactaacattgagcttgagcccccttttggggattcctacatcgttattggagtgggtaattcagcgctgaccttgcactggttcaggaagggcagcagtatcgggaaaatgtttgaatctacatatcggggagccaagcgtatggcaatcctcggcgagaccgcttgggacttcggttcctga

SEQ ID NO: 1803 - RNA, 2376 nt, synthetic construct
  misc_feature 1..2376: note = derived and/or modified CDS sequence (opt3) from DENV-4 Consensus__C-P2A-SSc-prME
  source 1..2376: mol_type = other RNA
atgaaccagagaaagaaagtggtcaggccccctttcaatatgctgaagcgggagcgcaaccgagttagcaccccacaaggcctcgtgaaacgtttttccacagggcttttctctggaaagggtccgctgagaatggtattggcctttatcactttcttaagggtgctgtcaattccccctacggctggcatactaaaacggtgggggcagctcaagaagaataaagcaatcaagattctgatcggatttcgcaaagaaattggcagaatgcttaacatcctgaatggtaggaagcggaacttcgacttgctcaaactggccggggatgtcgagagtaatccaggacccagcaccataacactgctctgcttaatccctactgtgatggcgtttcacctgtccacccgcgacggcgaaccacttatgattgttgctaagcatgagcgaggcagacccttgctgttcaagacaaccgaagggatcaacaaatgtactctaattgccatggatctcggagagatgtgcgaggacacagtgacctacaagtgtcctctgcttgtcaatacggaaccagaggatatcgactgctggtgtaacctgacttctacctgggtgatgtatggtacatgcactcagtcgggcgaaaggcggcgtgagaaacgctcagtagcattgaccccgcacagcgggatgggactcgagacaagagccgaaacctggatgagttccgagggcgcttggaagcatgcacagagggttgaatcttggatactgcggaatcccggttttgccttactggctgggttcatggcctacatgattggacaaacgggcatccagcgaactgtgtttttcgtcctcatgatgcttgtggcgcctagctatggcatgcgctgtgtgggggtcggaaacagagattttgttgagggtgtgtccggcggggcatgggtagacctggtgttggaacacggaggctgcgtcacaaccatggcccagggtaaaccaactctagatttcgagctgacaaagaccacggctaaagaggtggccctcctgaggacctactgtattgaagcatcaatcagtaatatcacaactgctacccggtgccccacacagggggagccttatcttaaggaggaacaagaccagcagtacatttgtcgcagagatgttgtggacaggggctggggaaacggctgcgggctgttcggaaagggtggcgtcgtgacttgcgccaaatttagctgttctgggaagataaccggaaatttggtacagatcgaaaacctcgagtatacagttgtggtcaccgtgcataacggcgatactcacgcggtcggtaatgacacgtccaaccacggggtgacagccaccattactccacgttcacccagcgttgaggtgaaactgccggactacggcgaattaaccctggattgcgagcctcggagtggaatcgacttcaatgaaatgatactaatgaagatgaaaaagaagacatggctcgtacataaacaatggtttctggatcttcccttgccatggaccgcaggcgctgacacttctgaggtccactggaactacaaggaacgaatggtgacattcaaagttcctcatgccaagagacaggatgtgacggtcctggggtcccaggagggagctatgcacagcgccctcgcaggggccaccgaggtggactcgggcgatgggaatcacatgtttgctggacatctgaaatgtaaggtaaggatggaaaaacttcgcattaagggcatgtcttatactatgtgctccggtaagttctcaatcgacaaagagatggcggaaacacaacacgggaccacagtggttaaggtcaaatacgagggcgcaggagccccctgtaaggtgccaatcgagattcgggatgtgaacaaggaaaaagtcgttggcagagtgatcagtagcactcccctggctgagaataccaactccgtgacgaatattgaattggagcctccatttggggactcttatatagtaatcggagtcggcaacagcgccctcaccctgcattggttcaggaagggttcaagtattgggaaaatgtttgaatccacataccgcggagcaaagcgaatggccatcttaggcgagactgcttgggatttcggtagcgtgggcgggctgtttacctctctaggaaaagccgttcaccaggtgttcggctcagtctatacaactatgtttgggggagtgagttggatgatccggattctcataggcttcctggttctttggatcggtaccaatagccgtaacacgtccatggcaatgacatgcattgcggtgggtggaatcaccttgttcctgggctttactgtacaggcttga

SEQ ID NO: 1804 - RNA, 2043 nt, synthetic construct
  misc_feature 1..2043: note = derived and/or modified CDS sequence (opt3) from DENV-4 Consensus__SSopt-prME(F108S)
  source 1..2043: mol_type = other RNA
atgaagaggaaaaagagcaccatcacactgctctgccttattcccactgtgatggccttccacctgtccacgagagacggcgagcctttgatgatagtcgctaaacatgaacgggggcgcccattactgtttaagaccacagagggaatcaacaaatgtactctaattgcaatggatctcggtgaaatgtgcgaggacaccgttacatacaagtgtccgctgcttgtgaataccgaacccgaggatatcgactgctggtgtaacctgacttctacatgggtaatgtatgggacctgcacgcagtcaggcgagcgacgtagagaaaagaggagtgtggccttgactcctcacagcggaatgggcctcgagacccgggcggaaacatggatgtcctctgagggtgcttggaaacatgcccaacgcgtcgagtcgtggattctgagaaatccagggttcgcactgctcgccggatttatggcttacatgatcggccagactggcatacagaggaccgtgttctttgttttaatgatgctggtggcaccctcatatgggatgcggtgtgtcggagtgggtaaccgcgatttcgtagaaggcgttagcgggggagcctgggtggaccttgtcttggagcacggcggttgcgtgacaaccatggctcaggggaagcctacgctggattttgaactaactaaaacaaccgccaaggaggtggcgctcctgcgaacttactgtatcgaagcaagtatttccaatatcacaaccgccacgagatgcccaacccaaggagagccctatcttaaagaggaacaggaccagcagtacatttgtaggcgggatgtcgttgaccgtggctggggcaacgggtgcggactgtctggtaagggcggggtggtaacatgcgctaagttcagctgttccggaaaaatcactggcaatttggtgcaaatagagaacctcgaatataccgtcgtggttacagtgcataatggtgatactcacgccgtcgggaacgacacctcaaatcacggcgtgacagcaaccattactcctcgcagtccaagcgtagaggttaagctgccggattacggagaattaacgctggactgcgagcccagatctggcatcgactttaacgagatgattctcatgaaaatgaagaaaaagacatggcttgtgcataaacagtggttcctggatttgcctctaccatggaccgctggggccgacacttccgaagtccactggaattacaaggagaggatggtgacctttaaggtcccccatgcgaaacggcaggatgtgacagttctgggatcacaggaaggtgccatgcacagcgcactcgctggcgccaccgaggtggacagtggggatggaaaccacatgttcgctggccatctgaagtgtaaagtacgaatggaaaaacttcgcatcaagggtatgtcttatactatgtgctccgggaagtttagcatcgacaaggagatggccgagacacaacacggcacgaccgtcgtgaaagttaagtacgaaggagcaggcgccccttgtaaagtgccaattgagataagagatgtcaataaggaaaaagtggtagggagggtgatctcgtctactcccctggctgagaacacaaactccgttaccaatattgagttggaaccgcctttcggagactcatatatcgtcataggtgtgggcaacagtgcgctcacactgcattggttccggaaggggagctccattggaaagatgtttgagtctacttaccgcggcgcaaaaagaatggccatcttaggtgaaaccgcttgggatttcgggagcgtgggcggactgtttacgtcactaggcaaggccgtccaccaggttttcgggagtgtgtataccacaatgtttggaggcgtgtcctggatgatcaggattctcatcggtttcctggtactttggattgggactaatagccgtaacacctctatggcaatgacatgcatagccgtcggaggcatcactttgtttctgggtttcaccgtgcaggcttga

SEQ ID NO: 1805 - RNA, 2043 nt, synthetic construct
  misc_feature 1..2043: note = derived and/or modified CDS sequence (opt3) from DENV-4 Consensus__SSopt-prME(V96H)
  source 1..2043: mol_type = other RNA
atgaagaggaaaaagagcaccatcacactgctctgccttattcccactgtgatggccttccacctgtccacgagagacggcgagcctttgatgatagtcgctaaacatgaacgggggcgcccattactgtttaagaccacagagggaatcaacaaatgtactctaattgcaatggatctcggtgaaatgtgcgaggacaccgttacatacaagtgtccgctgcttgtgaataccgaacccgaggatatcgactgctggtgtaacctgacttctacatgggtaatgtatgggacctgcacgcagtcaggcgagcgacgtagagaaaagaggagtgtggccttgactcctcacagcggaatgggcctcgagacccgggcggaaacatggatgtcctctgagggtgcttggaaacatgcccaacgcgtcgagtcgtggattctgagaaatccagggttcgcactgctcgccggatttatggcttacatgatcggccagactggcatacagaggaccgtgttctttgttttaatgatgctggtggcaccctcatatgggatgcggtgtgtcggagtgggtaaccgcgatttcgtagaaggcgttagcgggggagcctgggtggaccttgtcttggagcacggcggttgcgtgacaaccatggctcaggggaagcctacgctggattttgaactaactaaaacaaccgccaaggaggtggcgctcctgcgaacttactgtatcgaagcaagtatttccaatatcacaaccgccacgagatgcccaacccaaggagagccctatcttaaagaggaacaggaccagcagtacatttgtaggcgggatcatgtcgaccgtggctggggcaacgggtgcggactgttcggtaagggcggggttgtgacatgcgctaagttttcttgtagcggaaaaatcactggcaatttggtacaaatagagaacctcgaatataccgtggtcgtgacagttcacaatggtgatactcacgccgtggggaacgacacctccaatcatggcgtcacagcaaccattactcctcgctcaccaagtgtggaggtaaagctgccggattacggagaattaacgctggactgcgagcccagaagcggcatcgacttcaacgagatgattctcatgaaaatgaagaaaaagacatggcttgttcacaaacagtggtttctggatttgcctctaccatggaccgctggggccgacacttctgaagtgcattggaattacaaggagaggatggtcaccttcaaggtgccccacgcgaaacggcaggatgtcacagtgctgggatcccaggaaggtgccatgcactcagcactcgctggcgccaccgaggttgacagcggggatggaaaccatatgtttgctggccacctgaagtgtaaagtgcgaatggaaaaacttcgcatcaagggtatgagttatactatgtgctctgggaagttctccatcgacaaggagatggccgagacacaacatggcacgaccgtagtcaaagtgaagtacgaaggagcaggcgccccttgtaaagttccaattgagataagagatgtgaataaggaaaaagtcgtggggagggtaatcagctcgactcccctggctgagaacacaaactctgtgaccaatattgagttggaaccgcctttcggagactcctatatcgttataggtgtcggcaactcagcgctcacactgcactggtttcggaaggggagtagcattggaaagatgttcgagtccacttaccgcggcgcaaaaagaatggccatcttaggtgaaaccgcttgggattttgggtctgtgggcggactgttcacgagcctaggcaaggccgtgcatcaggtctttgggtcagtttataccacaatgttcggaggcgtgagttggatgatcaggattctcatcggttttctggtgctttggattgggactaattcccgtaacaccagcatggcaatgacatgcatagccgtaggaggcatcactttgttcctgggttttaccgtccaggcttga

SEQ ID NO: 1806 - RNA, 2043 nt, synthetic construct
  misc_feature 1..2043: note = derived and/or modified CDS sequence (opt3) from DENV-4 Consensus__SSopt-prME(E186F)
  source 1..2043: mol_type = other RNA
atgaagaggaaaaagagcaccatcacactgctctgccttattcccactgtgatggccttccacctgtccacgagagacggcgagcctttgatgatagtcgctaaacatgaacgggggcgcccattactgtttaagaccacagagggaatcaacaaatgtactctaattgcaatggatctcggtgaaatgtgcgaggacaccgttacatacaagtgtccgctgcttgtgaataccgaacccgaggatatcgactgctggtgtaacctgacttctacatgggtaatgtatgggacctgcacgcagtcaggcgagcgacgtagagaaaagaggagtgtggccttgactcctcacagcggaatgggcctcgagacccgggcggaaacatggatgtcctctgagggtgcttggaaacatgcccaacgcgtcgagtcgtggattctgagaaatccagggttcgcactgctcgccggatttatggcttacatgatcggccagactggcatacagaggaccgtgttctttgttttaatgatgctggtggcaccctcatatgggatgcggtgtgtcggagtgggtaaccgcgatttcgtagaaggcgttagcgggggagcctgggtggaccttgtcttggagcacggcggttgcgtgacaaccatggctcaggggaagcctacgctggattttgaactaactaaaacaaccgccaaggaggtggcgctcctgcgaacttactgtatcgaagcaagtatttccaatatcacaaccgccacgagatgcccaacccaaggagagccctatcttaaagaggaacaggaccagcagtacatttgtaggcgggatgtcgttgaccgtggctggggcaacgggtgcggactgttcggtaagggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgctcaccaagtgtagaggttaagctgccggattacggagaattaacgctggactgcttccccagaagcggcatcgactttaacgagatgattctcatgaaaatgaagaaaaagacatggcttgtgcataaacagtggttcctggatttgcctctaccatggaccgctggggccgacacttctgaggtccactggaattacaaggaaaggatggtgacctttaaggtcccccatgcgaaacggcaggatgtgacagttctgggatcccaggagggtgccatgcactcagcactcgctggcgccaccgaagtggacagcggggatggaaaccacatgttcgctggccatctgaagtgtaaagtacgaatggagaaacttcgcatcaagggtatgagttatactatgtgctctgggaagttctccatcgacaaggaaatggccgagacacaacacggcacgaccgtcgtgaaagttaagtacgagggagcaggcgccccttgtaaagtgccaattgaaataagagatgtcaataaggagaaagtggtagggagggtgatcagctcgactcccctggctgaaaacacaaactctgttaccaatattgagttggagccgccttttggagactcctatatcgtcataggtgtgggcaactcagcgctcacactgcattggttccggaaggggagtagcattggaaagatgtttgaatccacttaccgcggcgcaaaaagaatggccatcttaggtgagaccgcttgggatttcgggtctgtgggcggactgtttacgagcctaggcaaggccgtccaccaggttttcgggtcagtgtataccacaatgtttggaggcgtgagttggatgatcaggattctcatcggtttcctggtactttggattgggactaattcccgtaacaccagcatggcaatgacatgcatagccgtcggaggcatcactttgtttctgggtttcaccgtgcaggcttga

SEQ ID NO: 1807 - RNA, 2043 nt, synthetic construct
  misc_feature 1..2043: note = derived and/or modified CDS sequence (opt3) from DENV-4 Consensus__SSopt-prME(R188L)
  source 1..2043: mol_type = other RNA
atgaagaggaaaaagagcaccatcacactgctctgccttattcccactgtgatggccttccacctgtccacgagagacggcgagcctttgatgatagtcgctaaacatgaacgggggcgcccattactgtttaagaccacagagggaatcaacaaatgtactctaattgcaatggatctcggtgaaatgtgcgaggacaccgttacatacaagtgtccgctgcttgtgaataccgaacccgaggatatcgactgctggtgtaacctgacttctacatgggtaatgtatgggacctgcacgcagtcaggcgagcgacgtagagaaaagaggagtgtggccttgactcctcacagcggaatgggcctcgagacccgggcggaaacatggatgtcctctgagggtgcttggaaacatgcccaacgcgtcgagtcgtggattctgagaaatccagggttcgcactgctcgccggatttatggcttacatgatcggccagactggcatacagaggaccgtgttctttgttttaatgatgctggtggcaccctcatatgggatgcggtgtgtcggagtgggtaaccgcgatttcgtagaaggcgttagcgggggagcctgggtggaccttgtcttggagcacggcggttgcgtgacaaccatggctcaggggaagcctacgctggattttgaactaactaaaacaaccgccaaggaggtggcgctcctgcgaacttactgtatcgaagcaagtatttccaatatcacaaccgccacgagatgcccaacccaaggagagccctatcttaaagaggaacaggaccagcagtacatttgtaggcgggatgtcgttgaccgtggctggggcaacgggtgcggactgttcggtaagggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgctcaccaagtgtagaggttaagctgccggattacggagaattaacgctggactgcgagcccctcagcggcatcgacttcaacgagatgattcttatgaaaatgaagaaaaagacatggctggtgcataaacagtggtttttggatctacctctgccatggaccgctggggccgacacttctgaagtccactggaattacaaggagagaatggtgaccttcaaggtcccccatgcgaaaaggcaggatgtgacagttctcggatcccaggaaggtgccatgcactcagcactggctggcgccaccgaggtggacagcggggatggaaaccacatgtttgctggccatcttaagtgtaaagtacggatggaaaagctgcgaatcaaaggtatgagttatactatgtgctctgggaagttctccatcgacaaggagatggccgagacacaacacggcacgaccgtcgtgaaagttaagtacgaaggagcaggcgccccttgtaaagtgccaattgagatacgcgatgtcaataaggaaaaagtggtagggagagtgatcagctcgactcccttggctgagaacacaaactctgttaccaatattgagctcgaaccgcctttcggagactcctatatcgtcataggtgtgggcaactcagcgctgacattacattggtttaggaaggggagtagcattggaaagatgttcgagtccacttaccggggcgcaaaacgcatggccatcctgggtgaaaccgcttgggattttgggtctgtgggcggactattcacgagcctcggcaaggccgtccaccaggtttttgggtcagtgtataccacaatgttcggaggcgtgagttggatgatcaggattctgatcggttttcttgtattgtggattgggactaattccagaaacaccagcatggcaatgacatgcatagccgtcggaggcatcactctgttcctcggttttaccgtgcaggcttga

SEQ ID NO: 1808 - RNA, 2043 nt, synthetic construct
  misc_feature 1..2043: note = derived and/or modified CDS sequence (opt3) from DENV-4 Consensus__SSopt-pr(D104A)MEdelstem_TM,(F108S)-JEV
  source 1..2043: mol_type = other RNA
atgaagaggaaaaagagcaccatcacactgctctgccttattcccactgtgatggccttccacctgtccacgagagacggcgagcctttgatgatagtcgctaaacatgaacgggggcgcccattactgtttaagaccacagagggaatcaacaaatgtactctaattgcaatggatctcggtgaaatgtgcgaggacaccgttacatacaagtgtccgctgcttgtgaataccgaacccgaggatatcgactgctggtgtaacctgacttctacatgggtaatgtatgggacctgcacgcagtcaggcgagcgacgtagagccaagaggagtgtggcgttgactcctcacagcggaatgggcctcgaaacccgggctgagacatggatgtcctctgaaggtgcctggaaacatgcacaacgcgtcgagtcgtggattctgagaaatccagggttcgccctgctcgctggatttatggcatacatgatcggccagactggcatacagaggaccgtgttctttgttttaatgatgctggtggccccctcatatgggatgcggtgtgtcggagtgggtaaccgcgatttcgtagagggcgttagcgggggagcttgggtggaccttgtcttggaacacggcggttgcgtgacaaccatggcccaggggaagcctacgctggattttgagctaactaaaacaaccgcgaaggaagtggcactcctgcgaacttactgtatcgaggccagtatttccaatatcacaaccgctacgagatgcccaacccaaggagaaccctatcttaaagaggagcaggaccagcagtacatttgtaggcgggatgtcgttgaccgtggctggggcaacgggtgcggactgtctggtaagggcggggtggtaacatgcgccaagttcagctgttccggaaaaatcactggcaatttggtgcaaatagaaaacctcgagtataccgtcgtggttacagtgcataatggtgatactcacgcagtcgggaacgacacctcaaatcacggcgtgacagctaccattactcctcgcagtccaagcgtagaagttaagctgccggattacggagagttaacgctggactgcgaacccagatctggcatcgactttaacgagatgattctcatgaaaatgaagaaaaagacatggcttgtgcataaacagtggttcctggatttgcctctaccatggaccgccggggcggacacttccgaggtccactggaattacaaggaaaggatggtgacctttaaggtcccccatgccaaacggcaggatgtgacagttctgggatcacaggagggtgcaatgcacagcgctctcgccggcgctaccgaagtggacagtggggatggaaaccacatgttcgccggccatctgaagtgtaaagtacgaatggagaaacttcgcatcaagggtatgtcttatactatgtgctccgggaagtttagcatcgacaaggaaatggcagagacacaacacggcacgaccgtcgtgaaagttaagtacgagggagccggcgctccttgtaaagtgccaattgaaataagagatgtcaataaggagaaagtggtagggagggtgatctcgtctactcccctggcggaaaacacaaactccgttaccaatattgagttggagccgcctttcggagactcatatatcgtcataggtgtgggcaacagtgcactcacactgcattggttccggaaggggagcactttaggaaaggccttttccaccacgctgaaaggcgctcagcgcctagccgcactcggtgataccgcctgggacttcgggtctattggcggagtgtttaatagcatcggcagagctgtccaccaggttttcgggggagcctttaggacactgttcggcggtatgtcatggatcactcaagggcttatgggagcattgctgctctggatgggcgtgaacgcgcgtgatcggagtattgctctggcctttcttgcaaccggtggcgtgctggtattcttggccacaaatgtccatgcttga

SEQ ID NO: 1809 - RNA, 2043 nt, synthetic construct
  misc_feature 1..2043: note = derived and/or modified CDS sequence (opt3) from DENV-4 Consensus__SSopt-prMEdelstem_TM,(H261N)-JEV
  source 1..2043: mol_type = other RNA
atgaagaggaaaaagagcaccatcacactgctctgccttattcccactgtgatggccttccacctgtccacgagagacggcgagcctttgatgatagtcgctaaacatgaacgggggcgcccattactgtttaagaccacagagggaatcaacaaatgtactctaattgcaatggatctcggtgaaatgtgcgaggacaccgttacatacaagtgtccgctgcttgtgaataccgaacccgaggatatcgactgctggtgtaacctgacttctacatgggtaatgtatgggacctgcacgcagtcaggcgagcgacgtagagaaaagaggagtgtggccttgactcctcacagcggaatgggcctcgagacccgggcggaaacatggatgtcctctgagggtgcttggaaacatgcccaacgcgtcgagtcgtggattctgagaaatccagggttcgcactgctcgccggatttatggcttacatgatcggccagactggcatacagaggaccgtgttctttgttttaatgatgctggtggcaccctcatatgggatgcggtgtgtcggagtgggtaaccgcgatttcgtagaaggcgttagcgggggagcctgggtggaccttgtcttggagcacggcggttgcgtgacaaccatggctcaggggaagcctacgctggattttgaactaactaaaacaaccgccaaggaggtggcgctcctgcgaacttactgtatcgaagcaagtatttccaatatcacaaccgccacgagatgcccaacccaaggagagccctatcttaaagaggaacaggaccagcagtacatttgtaggcgggatgtcgttgaccgtggctggggcaacgggtgcggactgttcggtaagggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgctcaccaagtgtagaggttaagctgccggattacggagaattaacgctggactgcgagcccagaagcggcatcgacttcaacgagatgattctcatgaaaatgaagaaaaagacatggcttgtgcataaacagtggtttctggatttgcctctaccatggaccgctggggccgacacttctgaagtccactggaattacaaggagaggatggtgaccttcaaggtcccccatgcgaaacggcaggatgtgacagttctgggatcccaggaaggtgccatgaactcagcactcgctggcgccaccgaggtggacagcggggatggaaatcacatgtttgctggccacctgaagtgtaaagtacgaatggaaaaacttcgcatcaagggtatgagttatactatgtgctctgggaagttctccatcgacaaggagatggccgagacacaacatggcacgaccgtcgtgaaagttaagtacgaaggagcaggcgccccttgtaaagtgccaattgagataagagatgtcaacaaggaaaaagtggtagggagggtgatcagctcgactcccctggctgagaacacaaattctgttaccaacattgagttggaaccgcctttcggagactcctatatcgtcataggtgtgggcaattcagcgctcacactgcactggtttcggaaggggagtactttaggaaaggcattcagcaccacgctgaaaggcgcccagcgcctagctgccctcggtgataccgcatgggactttgggtccattggcggagtgttcaactctatcggcagagccgtccatcaggtttttgggggagctttcaggacactgtttggcggtatgagctggatcactcaagggcttatgggagccttgctgctctggatgggcgtgaatgcacgtgatcggtcaattgcgctggctttccttgccaccggtggcgtgctggtatttttggcaacaaacgtccacgcctga

SEQ ID NO: 1810 - RNA, 2043 nt, synthetic construct
  misc_feature 1..2043: note = derived and/or modified CDS sequence (opt3) from DENV-4 Consensus__SSopt-prMEdelstem_TM,(R188L,A267T)-JEV
  source 1..2043: mol_type = other RNA
atgaagaggaaaaagagcaccatcacactgctctgccttattcccactgtgatggccttccacctgtccacgagagacggcgagcctttgatgatagtcgctaaacatgaacgggggcgcccattactgtttaagaccacagagggaatcaacaaatgtactctaattgcaatggatctcggtgaaatgtgcgaggacaccgttacatacaagtgtccgctgcttgtgaataccgaacccgaggatatcgactgctggtgtaacctgacttctacatgggtaatgtatgggacctgcacgcagtcaggcgagcgacgtagagaaaagaggagtgtggccttgactcctcacagcggaatgggcctcgagacccgggcggaaacatggatgtcctctgagggtgcttggaaacatgcccaacgcgtcgagtcgtggattctgagaaatccagggttcgcactgctcgccggatttatggcttacatgatcggccagactggcatacagaggaccgtgttctttgttttaatgatgctggtggcaccctcatatgggatgcggtgtgtcggagtgggtaaccgcgatttcgtagaaggcgttagcgggggagcctgggtggaccttgtcttggagcacggcggttgcgtgacaaccatggctcaggggaagcctacgctggattttgaactaactaaaacaaccgccaaggaggtggcgctcctgcgaacttactgtatcgaagcaagtatttccaatatcacaaccgccacgagatgcccaacccaaggagagccctatcttaaagaggaacaggaccagcagtacatttgtaggcgggatgtcgttgaccgtggctggggcaacgggtgcggactgttcggtaagggcggggtggtaacatgcgctaagttttcttgtagcggaaaaatcactggcaatttggtgcaaatagagaacctcgaatataccgtcgtggttacagtgcataatggtgatactcacgccgtcgggaacgacacctccaatcacggcgtgacagcaaccattactcctcgctcaccaagtgtagaggttaagctgccggattacggagaattaacgctggactgcgagcccctcagcggcatcgacttcaacgagatgattcttatgaaaatgaagaaaaagacatggctggtgcataaacagtggtttttggatctacctctgccatggaccgctggggccgacacttctgaagtccactggaattacaaggagagaatggtgaccttcaaggtcccccatgcgaaaaggcaggatgtgacagttctcggatcccaggaaggtgccatgcactcagcactggctggcaccactgaggtggacagcggggatggaaaccacatgtttgccggccatcttaagtgtaaagtacggatggaaaagctgcgaatcaaaggtatgagttatacaatgtgctctgggaagttctccatcgacaaggagatggctgagacgcaacacggcaccactgtcgtgaaagttaagtacgaaggagccggcgcaccttgtaaagtgccaattgagatacgcgatgtcaataaggaaaaagtggtagggagagtgatcagctcgacacccttggccgagaacaccaactctgttacaaatattgagctcgaaccgcctttcggagactcctatatcgtcataggtgtgggcaactcagctctgactttacattggtttaggaaggggagtaccctgggaaaggcgttcagcacgaccctaaaaggcgcacagcggctcgccgctctgggtgatacagcctgggactttgggtccattggcggagtgttcaattctatcggccgcgcagtccaccaggtttttgggggagccttcagaactctttttggcggtatgagctggatcacccaagggttgatgggagctctgctcctgtggatgggcgtgaacgccagggatcgttcaattgcacttgcgttcctggctacaggtggcgtgttggtatttctcgccactaatgtccatgcatga

SEQ ID NO: 1811 - RNA, 300 nt, synthetic construct
  misc_feature 1..300: note = derived and/or modified CDS sequence (opt3) from DENV-3 Consensus__C
  source 1..300: mol_type = other RNA
atgaacaatcagagaaagaaaaccggcaagcccagcatcaacatgctgaaaagggtgcggaatcgcgtctccacagggtctcaactcgccaagcgattctcaaaaggacttctgaacggtcagggccctatgaagttggttatggcttttattgcattcttacgttttctggccataccaccgactgcgggggtgctagctagatggggaacgttcaagaaaagtggcgccatcaaggtactcaaaggttttaagaaagagattagcaatatgctgtccatcattaacaagaggaagaaa

SEQ ID NO: 1812 - RNA, 342 nt, synthetic construct
  misc_feature 1..342: note = derived and/or modified CDS sequence (opt3) from DENV-3 Consensus__C-SSc
  source 1..342: mol_type = other RNA
atgaacaatcagagaaagaaaaccggcaagcccagcatcaacatgctgaaaagggtgcggaatcgcgtctccacagggtctcaactcgccaagcgattctcaaaaggacttctgaacggtcagggccctatgaagttggttatggcttttattgcattcttacgttttctggccataccaccgactgcgggggtgctagctagatggggaacgttcaagaaaagtggcgccatcaaggtactcaaaggttttaagaaagagattagcaatatgctgtccatcattaacaagaggaagaaaacctctctttgcctgatgatgatcttgcccgcagccctcgct

SEQ ID NO: 1813 - RNA, 273 nt, synthetic construct
  misc_feature 1..273: note = derived and/or modified CDS sequence (opt3) from DENV-3 Consensus__pr
  source 1..273: mol_type = other RNA
ttccacctgaccagcagagacggcgagcccaggatgatcgtggggaagaacgaacggggaaaatccctcctttttaagacagcctctggtattaatatgtgcactctgatagctatggatttgggcgagatgtgtgacgatacggtcacctacaaatgccctcatatcacagaagttgagccagaagacattgattgttggtgcaacttaacttcaacctgggtgacatatgggacctgtaatcaggcaggagagcaccgccgagacaagcgt

SEQ ID NO: 1814 - RNA, 225 nt, synthetic construct
  misc_feature 1..225: note = derived and/or modified CDS sequence (opt3) from DENV-3 Consensus__M
  source 1..225: mol_type = other RNA
agcgtggccctggctccccacgtcggcatggggctcgacaccagaacacagacttggatgtccgcagagggagcctggaggcaagttgaaaaggtggagacgtgggcgcttcggcatcctggtttcaccatcctggctttgtttttagcccactacattggcacatctctgactcagaaagtagtgatattcatcctactcatgctggtcaccccatcaatgaca

SEQ ID NO: 1815 - RNA, 498 nt, synthetic construct
  misc_feature 1..498: note = derived and/or modified CDS sequence (opt3) from DENV-3 Consensus__prM
  source 1..498: mol_type = other RNA
ttccacctgaccagcagagacggcgagcccaggatgatcgtggggaagaacgaacggggaaaatccctcctttttaagacagcctctggtattaatatgtgcactctgatagctatggatttgggcgagatgtgtgacgatacggtcacctacaaatgccctcatatcacagaagttgagccagaagacattgattgttggtgcaacttaacttcaacctgggtgacatatgggacctgtaatcaggcaggagagcaccgccgagacaagcgtagtgtagccctggcgccgcatgtgggcatgggtctagatactagaacacaaacctggatgagcgctgagggggcctggaggcaggtcgaaaaagtggagacgtgggcactccggcaccccggattcactatcctggccctttttctggctcattacattggcacctccttgacacagaaggttgtgatcttcatactcctgatgctggtcactccttctatgacc

SEQ ID NO: 1816 - RNA, 1479 nt, synthetic construct
  misc_feature 1..1479: note = derived and/or modified CDS sequence (opt3) from DENV-3 Consensus__E
  source 1..1479: mol_type = other RNA
atgagatgcgtgggcgtcgggaacagggacttcgttgagggactgagcggtgccacctgggtggatgtagtgctcgaacacggcgggtgtgtcacaactatggctaagaataaacccacgcttgacatcgagctgcagaagaccgaagcaacacaattggccactttacggaaactgtgcattgagggaaagataaccaacatcacaaccgattcccgctgtcctactcagggcgaagcgacactaccagaggagcaggaccagaattacgtgtgcaaacatacctatgttgatcgaggttgggggaacggatgtggcctctttggcaaggggtctctggtgacgtgcgctaagttccaatgtcttgaaccgattgagggaaaagtcgtgcagtacgaaaatctgaagtatactgtaatcattaccgttcacacaggtgaccagcatcaggtgggcaacgagactcaaggggtcaccgccgagatcacaccccaggcatcaaccacggaagccatattgcctgagtacggaactctcggcctggaatgcagtccacgtacaggtctggattttaatgagatgatcctcttaaccatgaaaaacaaggcttggatggtgcacagacagtggttctttgacctgccccttccttggactagcggggcaacaaccgaaacgccaacctggaataggaaagagttgctggtgacattcaagaacgcccatgctaagaaacaggaggtcgttgtgctaggatcccaagaaggcgccatgcacactgcgctcaccggcgcaacagagattcaaaattctgggggaacttcgatctttgccggtcacctgaagtgtcggcttaaaatggataagctggaattgaaaggcatgtcatatgctatgtgcaccaacacattcgtactcaagaaagaggtgagcgaaacccagcatgggactattctgatcaaggtcgagtacaagggagaggacgtgccctgtaaaataccttttagtacggaagatggccagggtaaggcccacaatgggcgcttaattacagcaaacccagttgtgaccaaaaaggaggaaccggtcaatatcgaggctgaaccccctttcggcgagtccaacattgtgatcggaatcggcgacaacgccctgaaaattaattggtataagaaggggtctagcataggaaaaatgtttgaggcgactgccagaggtgcaaggcggatggctatcctcggcgataccgcctgggacttcgggtccgtaggaggcgttcttaactcactgggtaagatggtgcatcagatttttgggagtgcttacacagccttgttcagcggcgtctcttgggtgatgaaaatcggaataggcgtcctactgacctggattgggctcaattccaagaacacttcaatgagcttcagttgcatcgcaatcggaattatcacactgtaccttggtgccgtggttcaggct

SEQ ID NO: 1817 - RNA, 1977 nt, synthetic construct
  misc_feature 1..1977: note = derived and/or modified CDS sequence (opt3) from DENV-3 Consensus__prME
  source 1..1977: mol_type = other RNA
ttccacctgaccagcagagacggcgagcccaggatgatcgtggggaagaacgaacggggaaaatccctcctttttaagacagcctctggtattaatatgtgcactctgatagctatggatttgggcgagatgtgtgacgatacggtcacctacaaatgccctcatatcacagaagttgagccagaagacattgattgttggtgcaacttaacttcaacctgggtgacatatgggacctgtaatcaggcaggagagcaccgccgagacaagcgtagtgtagccctggcgccgcatgtgggcatgggtctagatactagaacacaaacctggatgagcgctgagggggcctggaggcaggtcgaaaaagtggagacgtgggcactccggcaccccggattcactatcctggccctttttctggctcattacattggcacctccttgacacagaaggttgtgatcttcatactcctgatgctggtcactccttctatgaccatgcgctgcgtgggcgtagggaacagagactttgttgaaggactctcgggtgcaacatgggtggatgtcgtgttagagcacggcgggtgtgtgaccacgatggccaagaataaaccaactctggacatcgagcttcagaagacagaagctacccaattggccactctgaggaaactatgcattgagggaaagatcacaaacattaccacggattcacggtgtcccacccagggcgaagcgacactccctgaggaacaggaccagaattatgtctgcaaacacacttacgttgatcgcggttgggggaacggatgtggcctgttcggcaaggggagccttgtgacctgcgcaaagtttcaatgcctggagccaatcgagggaaaagtagtgcagtatgaaaatttgaagtacacagtcataattactgtgcataccggtgaccagcaccaggttggcaacgagacacaaggggtgaccgccgaaatcactccccaggctagtacgacagaggccattctccctgaatatggaaccctgggcttagagtgttccccacgaactggtctggacttcaatgagatgatcctccttaccatgaaaaacaaggcatggatggtccatagacagtggtttttcgatctgccgttgccctggacatctggggctaccactgaaacacctacgtggaataggaaagagctactggtgacctttaagaacgcccacgcgaaaaagcaagaagtagttgtgctcggcagccaggagggagccatgcacactgcactgacaggcgctaccgaaatccaaaattccgggggaacatcaattttcgccggtcatcttaagtgccggctgaaaatggacaagttggagctcaaaggcatgagttacgctatgtgtactaacacctttgtcctgaagaaagaggtgagcgaaacgcagcacgggaccatattaatcaaggtcgagtacaagggagaagatgtgccatgcaaaattcccttctctacagaggacggccagggtaaggcccataacgggcgtctgatcactgcaaatcctgttgtgaccaaaaaggaggaaccagtaaacatagaggccgaacccccgttcggcgagtccaatattgtcatcggaatcggcgataacgctctaaaaattaattggtataagaaggggtcaagcatcggaaaaatgtttgaagcgacagcacgcggtgccagaaggatggctattctcggcgacactgcctgggatttcgggagtgtgggaggcgttctgaactctcttggtaagatggtgcaccagatatttgggtccgcatacaccgccttgttcagcggcgtctcgtgggtgatgaaaatcggaattggcgtactgctcacgtggatcgggcttaattctaagaacacatccatgtcatttagttgtatcgctattggaataatcaccctgtatctgggcgccgtggttcaggca

SEQ ID NO: 1818 - RNA, 2019 nt, synthetic construct
  misc_feature 1..2019: note = derived and/or modified CDS sequence (opt3) from DENV-3 Consensus__SSc-prME
  source 1..2019: mol_type = other RNA
accagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccagggtaaggctcataacgggcgtcttataaccgcgaatccagttgtgactaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggcc

SEQ ID NO: 1819 - RNA, 1056 nt, synthetic construct
  misc_feature 1..1056: note = derived and/or modified CDS sequence (opt3) from DENV-3 Consensus__NS1
  source 1..1056: mol_type = other RNA
gacatgggctgcgtgatcaactggaaggggaaagagctgaagtgtggaagcggtattttcgtcaccaatgaagttcacacatggactgagcagtacaaatttcaagccgattcccccaagagactcgctacggcaatagccggcgcgtgggaaaacggggtgtgcggaatcaggtctaccacacggatggagaatcttctgtggaaacagattgctaacgaattgaattatatcttatgggagaacaatattaagctgactgtagtggtcggcgacatcataggtgtgctagagcaggggaagcgcaccctcacacctcagccaatggaactgaaatactcatggaagacctggggaaaagccaagatcgttactgcagagacacaaaacagtagcttcattatcgatggcccgaatacccccgaatgtccttccgtgtctcgagcctggaacgtctgggaggtggaggactatggctttggggtattcacgactaatatttggcttaaactgcgtgaagtttacacccagttgtgcgatcatagactcatgtcggctgcagtgaaggacgagagggccgtccacgctgatatgggatattggatcgaatcacagaagaacggtagctggaaactggagaaggccagtctgatagaagtgaaaacatgtacttggccaaagtcccataccctctggtctaatggcgtgttagagagcgacatgattatccccaaatccctggcggggcctatttcacagcacaaccatcggccaggataccacacacaaaccgcaggcccctggcaccttggtaagttggagctggattttaattattgcgaagggacgactgtcgttatcacagagaactgtggaacccgcggccctagtctaagaactacaaccgtgagcggcaaactcatccatgaatggtgctgtaggtcttgcacgctgccaccgcttcggtacatgggggaggacggatgttggtacggtatggaaattcgccccatatccgagaaggaggaaaacatggtaaagtcactggtgagcgcc

SEQ ID NO: 1820 - RNA, 1857 nt, synthetic construct
  misc_feature 1..1857: note = derived and/or modified CDS sequence (opt3) from DENV-3 Consensus__NS3
  source 1..1857: mol_type = other RNA
agcggcgtgctgtgggacgtcccctcccctccagagacccagaaggccgaactcgaggaaggggtttacagaatcaaacaacagggaattttcggtaagacacaggtgggcgtaggggtgcagaaagagggagtctttcacactatgtggcatgtgacgaggggcgctgttcttacctataacggtaagcggctggaaccgaattgggcatctgtgaaaaaggatttgatatcatacgggggaggctggcgcttaagtgcccaatggcagaagggcgaggaggtccaggtgatcgcggtagaacccgggaaaaaccctaagaatttccagacaatgccaggaacttttcaaaccacaaccggtgagattggcgctatcgccctggacttcaaacccgggactagcggatcccctattatcaaccgagaaggcaaggttgtgggtctatatgggaatggagtcgtgaccaaaaacggcggctacgtgtctgggatagcacagacaaatgccgagccagatggacccacgcctgagctcgaagaggaaatgtttaagaagcgtaacctgactatcatggaccttcacccaggttcgggcaaaaccagaaagtatctgccggctattgtcagggaggcaatcaaacggcgcttgagaacactcattctggcccccactagggttgtggctgccgaaatggaggaggcgctgaaggggctccctatccggtaccagaccacagcaaccaaatcagaacatacgggacgcgagatagtagatttaatgtgccacgccactttcacaatgcgactgcttagcccagtgagagtccccaattataacttgattatcatggacgaagctcattttaccgatcctgccagtattgcagctaggggctacatctccactcgggtgggtatgggggaggccgcggccatcttcatgacagcaaccccacccggcacggctgacgcctttccgcagtctaatgctcctattcaagatgaggaacgtgacatacccgagcgcagctggaactccggaaatgaatggatcaccgatttcgccggcaagacagtttggtttgtgccatcaattaaagcagggaacgacatcgccaattgtctgagaaagaacggaaagaaagtcatacagctaagtaggaagactttcgataccgagtaccagaaaacaaagctcaacgactgggactttgtggtaactaccgatattagcgaaatgggtgctaatttcaaagcggaccgggttatcgatcctcgacgctgcctgaagcccgtgatccttacagacggcccagagagagtcattctggcagggcccatgcctgtgaccgccgcttctgccgcacaaaggcggggacgcgtcggcagaaacccacagaaggaaaatgatcagtatatcttcactggtcagccgttgaacaatgacgaggatcacgcccactggacggaggctaaaatgctcctggacaacattaatacacccgaagggataatccctgccttatttgagccagaaagggagaagtccgcagcgattgatggcgagtaccgtctgaaaggagaatcacggaagaccttcgtggagctcatgcgaagaggcgaccttcccgtttggctggctcataaagtggccagcgaagggatcaagtatactgataggaagtggtgttttgacggacaacgcaacaatcagatcttggaggaaaacatggacgtagagatttggaccaaagagggtgaaaagaaaaagctacggcctagatggctggatgcaaggacatacagtgacccactcgccctgaaagagttcaaggaatttgctgccggccgcaag

SEQ ID NO: 1821 - RNA, 2319 nt, synthetic construct
  misc_feature 1..2319: note = derived and/or modified CDS sequence (opt3) from DENV-3 Consensus__C-prME
  source 1..2319: mol_type = other RNA
atgaacaatcagagaaagaaaaccggcaagcccagcatcaacatgctgaaaagggtgcggaatcgcgtctccacagggtctcaactcgccaagcgattctcaaaaggacttctgaacggtcagggccctatgaagttggttatggcttttattgcattcttacgttttctggccataccaccgactgcgggggtgctagctagatggggaacgttcaagaaaagtggcgccatcaaggtactcaaaggttttaagaaagagattagcaatatgctgtccatcattaacaagaggaagaaaacctctctttgcctgatgatgatcttgcccgcagccctcgctttccacctgacatcgcgggacggggaacctcgcatgatagtgggaaagaatgagagaggcaaatcactgctctttaagactgcaagcggcatcaacatgtgtaccttaattgccatggatctgggggaaatgtgcgacgatacagtcacctacaaatgtccacatatcactgaggtggaacccgaggacattgattgctggtgtaatcttacaagtacctgggttacgtatggaacttgcaaccaggctggtgagcacaggcgggacaagcgctccgtggccttggcgcctcatgtcggcatggggctggatacccgaacacagacttggatgtctgcagaaggagcctggagacaagtggagaaagtagaaacctgggctctaaggcacccaggcttcacaatcctcgccctgtttcttgcacattacataggtaccagcctgacgcagaaggttgtgattttcatcttgctcatgctggtcactccctccatgacaatgcggtgtgtgggggtgggaaatcgtgactttgtcgagggcttatcaggcgctacctgggttgatgtggtactggagcacgggggatgcgtgactacaatggccaagaacaaacctaccctcgacattgaacttcagaagacggaggcgacccagctggccacattgcgcaaactatgtatcgaaggtaagatcactaatattaccacagatagtagatgcccaactcaaggcgaggcaaccctgccggaagaacaggaccagaactatgtctgtaaacacacatacgtggatagggggtggggaaatggctgcggtctcttcgggaagggcagcctggttacctgcgctaagtttcagtgtcttgagcccatagaaggaaaagtggtccaatatgagaacctgaagtacactgtgatcattacggtacatacaggcgaccagcaccaggttgggaacgaaacccaaggagtgactgccgagatcacccctcaggcttctacaaccgaagccatattgccagagtatggtactctcggcctggagtgctcaccccggacagggttagacttcaatgaaatgattctgctaacgatgaaaaacaaggcatggatggtccatcgacagtggttctttgatctccctctgccatggacctccggagccactacagagacccccacatggaatcgcaaagaacttttggtgactttcaagaacgctcacgcgaagaaacaggaggtcgtggttctgggcagccaagaaggtgcaatgcacaccgccctcacgggggctaccgagatccagaatagtggcggaacatctatctttgccggccatctgaagtgtagacttaaaatggacaagctggagttgaaagggatgtcctacgcaatgtgcactaacaccttcgtgctcaagaaggaagtaagcgagacacagcacggaactattctgatcaaagtcgaatacaagggtgaggatgtgccgtgtaaaattcctttttcgaccgaggacggccaggggaaggcccataatggaaggttaataacggctaaccccgttgtgactaaaaaggaggagccagtcaatatcgaagccgagcctcccttcggcgaatctaacattgtgatcggtatcggggataatgcactgaaaattaactggtataagaagggctcctcaataggaaaaatgtttgaggcgaccgctcggggcgcccgcagaatggcaatcctaggggacactgcctgggatttcggaagtgtaggcggtgtgctcaatagcctggggaagatggttcaccaaatttttggatccgcttacacagcccttttctctggcgtcagctgggtgatgaaaatcggtattggcgtgttgctgacctggatcgggctcaactcaaagaatacaagtatgtcctttagctgcatagcaatcggaattatcaccctgtatttaggcgctgtcgttcaggcc

SEQ ID NO: 1822 - RNA, 45 nt, synthetic construct
  misc_feature 1..45: note = derived and/or modified CDS sequence (opt3) from DENV-3 Consensus__SSc
  source 1..45: mol_type = other RNA
atgaccagcctgtgcctcatgatgatccttcccgccgctctggca

SEQ ID NO: 1823 - RNA, 57 nt, synthetic construct
  misc_feature 1..57: note = derived and/or modified CDS sequence (opt3) from DENV-3 Consensus__SSopt
  source 1..57: mol_type = other RNA
atgaagagaaagaaaaccagcctgtgcctcatgatgatccttcccgccgctctggca

SEQ ID NO: 1824 - RNA, 57 nt, synthetic construct
  misc_feature 1..57: note = derived and/or modified CDS sequence (opt3) from DENV-3 Consensus__SSm
  source 1..57: mol_type = other RNA
atgacccagaaggtggtcatcttcattctgctcatgcttgttacacccagcatgact

SEQ ID NO: 1825 - RNA, 1482 nt, synthetic construct
  misc_feature 1..1482: note = derived and/or modified CDS sequence (opt3) from DENV-3 Consensus__E
  source 1..1482: mol_type = other RNA
atgagatgcgtgggcgtcgggaacagggacttcgttgagggactgagcggtgccacctgggtggatgtagtgctcgaacacggcgggtgtgtcacaactatggctaagaataaacccacgcttgacatcgagctgcagaagaccgaagcaacacaattggccactttacggaaactgtgcattgagggaaagataaccaacatcacaaccgattcccgctgtcctactcagggcgaagcgacactaccagaggagcaggaccagaattacgtgtgcaaacatacctatgttgatcgaggttgggggaacggatgtggcctctttggcaaggggtctctggtgacgtgcgctaagttccaatgtcttgaaccgattgagggaaaagtcgtgcagtacgaaaatctgaagtatactgtaatcattaccgttcacacaggtgaccagcatcaggtgggcaacgagactcaaggggtcaccgccgagatcacaccccaggcatcaaccacggaagccatattgcctgagtacggaactctcggcctggaatgcagtccacgtacaggtctggattttaatgagatgatcctcttaaccatgaaaaacaaggcttggatggtgcacagacagtggttctttgacctgccccttccttggactagcggggcaacaaccgaaacgccaacctggaataggaaagagttgctggtgacattcaagaacgcccatgctaagaaacaggaggtcgttgtgctaggatcccaagaaggcgccatgcacactgcgctcaccggcgcaacagagattcaaaattctgggggaacttcgatctttgccggtcacctgaagtgtcggcttaaaatggataagctggaattgaaaggcatgtcatatgctatgtgcaccaacacattcgtactcaagaaagaggtgagcgaaacccagcatgggactattctgatcaaggtcgagtacaagggagaggacgtgccctgtaaaataccttttagtacggaagatggccagggtaaggcccacaatgggcgcttaattacagcaaacccagttgtgaccaaaaaggaggaaccggtcaatatcgaggctgaaccccctttcggcgagtccaacattgtgatcggaatcggcgacaacgccctgaaaattaattggtataagaaggggtctagcataggaaaaatgtttgaggcgactgccagaggtgcaaggcggatggctatcctcggcgataccgcctgggacttcgggtccgtaggaggcgttcttaactcactgggtaagatggtgcatcagatttttgggagtgcttacacagccttgttcagcggcgtctcttgggtgatgaaaatcggaataggcgtcctactgacctggattgggctcaattccaagaacacttcaatgagcttcagttgcatcgcaatcggaattatcacactgtaccttggtgccgtggttcaggcttga

SEQ ID NO: 1826 - RNA, 1176 nt, synthetic construct
  misc_feature 1..1176: note = derived and/or modified CDS sequence (opt3) from DENV-3 Consensus__EdelTM-variant (aa1-392)
  source 1..1176: mol_type = other RNA
atgagatgcgtgggcgtcgggaacagggacttcgttgagggactgagcggtgccacctgggtggatgtagtgctcgaacacggcgggtgtgtcacaactatggctaagaataaacccacgcttgacatcgagctgcagaagaccgaagcaacacaattggccactttacggaaactgtgcattgagggaaagataaccaacatcacaaccgattcccgctgtcctactcagggcgaagcgacactaccagaggagcaggaccagaattacgtgtgcaaacatacctatgttgatcgaggttgggggaacggatgtggcctctttggcaaggggtctctggtgacgtgcgctaagttccaatgtcttgaaccgattgagggaaaagtcgtgcagtacgaaaatctgaagtatactgtaatcattaccgttcacacaggtgaccagcatcaggtgggcaacgagactcaaggggtcaccgccgagatcacaccccaggcatcaaccacggaagccatattgcctgagtacggaactctcggcctggaatgcagtccacgtacaggtctggattttaatgagatgatcctcttaaccatgaaaaacaaggcttggatggtgcacagacagtggttctttgacctgccccttccttggactagcggggcaacaaccgaaacgccaacctggaataggaaagagttgctggtgacattcaagaacgcccatgctaagaaacaggaggtcgttgtgctaggatcccaagaaggcgccatgcacactgcgctcaccggcgcaacagagattcaaaattctgggggaacttcgatctttgccggtcacctgaagtgtcggcttaaaatggataagctggaattgaaaggcatgtcatatgctatgtgcaccaacacattcgtactcaagaaagaggtgagcgaaacccagcatgggactattctgatcaaggtcgagtacaagggagaggacgtgccctgtaaaataccttttagtacggaagatggccagggtaaggcccacaatgggcgcttaattacagcaaacccagttgtgaccaaaaaggaggaaccggtcaatatcgaggctgaaccccctttcggcgagtccaacattgtgatcggaatcggcgacaacgccctgaaaattaattggtataagaag

SEQ ID NO: 1827 - RNA, 1269 nt, synthetic construct
  misc_feature 1..1269: note = derived and/or modified CDS sequence (opt3) from DENV-3 Consensus__EdelTM-variant (aa1-422)
  source 1..1269: mol_type = other RNA
atgagatgcgtgggcgtcgggaacagggacttcgttgagggactgagcggtgccacctgggtggatgtagtgctcgaacacggcgggtgtgtcacaactatggctaagaataaacccacgcttgacatcgagctgcagaagaccgaagcaacacaattggccactttacggaaactgtgcattgagggaaagataaccaacatcacaaccgattcccgctgtcctactcagggcgaagcgacactaccagaggagcaggaccagaattacgtgtgcaaacatacctatgttgatcgaggttgggggaacggatgtggcctctttggcaaggggtctctggtgacgtgcgctaagttccaatgtcttgaaccgattgagggaaaagtcgtgcagtacgaaaatctgaagtatactgtaatcattaccgttcacacaggtgaccagcatcaggtgggcaacgagactcaaggggtcaccgccgagatcacaccccaggcatcaaccacggaagccatattgcctgagtacggaactctcggcctggaatgcagtccacgtacaggtctggattttaatgagatgatcctcttaaccatgaaaaacaaggcttggatggtgcacagacagtggttctttgacctgccccttccttggactagcggggcaacaaccgaaacgccaacctggaataggaaagagttgctggtgacattcaagaacgcccatgctaagaaacaggaggtcgttgtgctaggatcccaagaaggcgccatgcacactgcgctcaccggcgcaacagagattcaaaattctgggggaacttcgatctttgccggtcacctgaagtgtcggcttaaaatggataagctggaattgaaaggcatgtcatatgctatgtgcaccaacacattcgtactcaagaaagaggtgagcgaaacccagcatgggactattctgatcaaggtcgagtacaagggagaggacgtgccctgtaaaataccttttagtacggaagatggccagggtaaggcccacaatgggcgcttaattacagcaaacccagttgtgaccaaaaaggaggaaccggtcaatatcgaggctgaaccccctttcggcgagtccaacattgtgatcggaatcggcgacaacgccctgaaaattaattggtataagaaggggtctagcataggaaaaatgtttgaggcgactgccagaggtgcaaggcggatggctatcctcggcgataccgcctgggacttcgggtcctga

SEQ ID NO: 1828 - RNA, 1260 nt, synthetic construct
  misc_feature 1..1260: note = derived and/or modified CDS sequence (opt3) from DENV-3 Consensus__EdelTM-variant (aa1-419)
  source 1..1260: mol_type = other RNA
atgagatgcgtgggcgtcgggaacagggacttcgttgagggactgagcggtgccacctgggtggatgtagtgctcgaacacggcgggtgtgtcacaactatggctaagaataaacccacgcttgacatcgagctgcagaagaccgaagcaacacaattggccactttacggaaactgtgcattgagggaaagataaccaacatcacaaccgattcccgctgtcctactcagggcgaagcgacactaccagaggagcaggaccagaattacgtgtgcaaacatacctatgttgatcgaggttgggggaacggatgtggcctctttggcaaggggtctctggtgacgtgcgctaagttccaatgtcttgaaccgattgagggaaaagtcgtgcagtacgaaaatctgaagtatactgtaatcattaccgttcacacaggtgaccagcatcaggtgggcaacgagactcaaggggtcaccgccgagatcacaccccaggcatcaaccacggaagccatattgcctgagtacggaactctcggcctggaatgcagtccacgtacaggtctggattttaatgagatgatcctcttaaccatgaaaaacaaggcttggatggtgcacagacagtggttctttgacctgccccttccttggactagcggggcaacaaccgaaacgccaacctggaataggaaagagttgctggtgacattcaagaacgcccatgctaagaaacaggaggtcgttgtgctaggatcccaagaaggcgccatgcacactgcgctcaccggcgcaacagagattcaaaattctgggggaacttcgatctttgccggtcacctgaagtgtcggcttaaaatggataagctggaattgaaaggcatgtcatatgctatgtgcaccaacacattcgtactcaagaaagaggtgagcgaaacccagcatgggactattctgatcaaggtcgagtacaagggagaggacgtgccctgtaaaataccttttagtacggaagatggccagggtaaggcccacaatgggcgcttaattacagcaaacccagttgtgaccaaaaaggaggaaccggtcaatatcgaggctgaaccccctttcggcgagtccaacattgtgatcggaatcggcgacaacgccctgaaaattaattggtataagaaggggtctagcataggaaaaatgtttgaggcgactgccagaggtgcaaggcggatggctatcctcggcgataccgcctgggactga

SEQ ID NO: 1829 - RNA, 1155 nt, synthetic construct
  misc_feature 1..1155: note = derived and/or modified CDS sequence (opt3) from DENV-3 Consensus__Edelaa101-107
  source 1..1155: mol_type = other RNA
atgagatgcgtgggcgtcgggaacagggacttcgttgagggactgagcggtgccacctgggtggatgtagtgctcgaacacggcgggtgtgtcacaactatggctaagaataaacccacgcttgacatcgagctgcagaagaccgaagcaacacaattggccactttacggaaactgtgcattgagggaaagataaccaacatcacaaccgattcccgctgtcctactcagggcgaagcgacactaccagaggagcaggaccagaattacgtgtgcaaacatacctatgttgatcgaggttttgggaagggatctctcgtgacgtgtgctaagttccaatgcctggaaccgattgagggcaaagtcgtgcagtacgaaaaccttaagtatactgtaatcattaccgttcacacaggcgaccagcatcaggtggggaatgagactcaaggagtcaccgccgagatcacaccccaggcatcaaccacggaagccatactgcctgagtacggtactttgggcctcgaatgtagtccacgtacagggctggattttaacgagatgatcctgctcaccatgaaaaataaggcttggatggtgcacagacagtggttctttgacttacccctgccttggactagcggagcaacaaccgaaacgccaacctggaacaggaaagagcttttggtgacattcaagaatgcccatgctaagaaacaggaggtcgttgtgctgggctcccaagaaggtgccatgcacactgcgctaaccggggcaacagagattcagaactctggaggcacttcgatctttgccggccacctcaagtgccggctgaaaatggataaacttgaactgaaggggatgtcatatgctatgtgtaccaatacattcgtattgaagaaagaggtgagcgaaacccagcatggaactattctcatcaaggtcgagtacaagggtgaggacgtgccctgcaaaataccttttagtacggaagatggccaagggaaggcccacaacggacgcctgattacagcaaatccagttgtgaccaaaaaggaggaaccggtcaacatcgaggctgaaccccctttcggcgagtccaatattgtgatcggtatcggggacaacgccttaaaaattaactggtataagaag

SEQ ID NO: 1830 - RNA, 1173 nt, synthetic construct
  misc_feature 1..1173: note = derived and/or modified CDS sequence (opt3) from DENV-3 Consensus__EdelTM-variant (aa1-391)
  source 1..1173: mol_type = other RNA
atgagatgcgtgggcgtcgggaacagggacttcgttgagggactgagcggtgccacctgggtggatgtagtgctcgaacacggcgggtgtgtcacaactatggctaagaataaacccacgcttgacatcgagctgcagaagaccgaagcaacacaattggccactttacggaaactgtgcattgagggaaagataaccaacatcacaaccgattcccgctgtcctactcagggcgaagcgacactaccagaggagcaggaccagaattacgtgtgcaaacatacctatgttgatcgaggttgggggaacggatgtggcctctttggcaaggggtctctggtgacgtgcgctaagttccaatgtcttgaaccgattgagggaaaagtcgtgcagtacgaaaatctgaagtatactgtaatcattaccgttcacacaggtgaccagcatcaggtgggcaacgagactcaaggggtcaccgccgagatcacaccccaggcatcaaccacggaagccatattgcctgagtacggaactctcggcctggaatgcagtccacgtacaggtctggattttaatgagatgatcctcttaaccatgaaaaacaaggcttggatggtgcacagacagtggttctttgacctgccccttccttggactagcggggcaacaaccgaaacgccaacctggaataggaaagagttgctggtgacattcaagaacgcccatgctaagaaacaggaggtcgttgtgctaggatcccaagaaggcgccatgcacactgcgctcaccggcgcaacagagattcaaaattctgggggaacttcgatctttgccggtcacctgaagtgtcggcttaaaatggataagctggaattgaaaggcatgtcatatgctatgtgcaccaacacattcgtactcaagaaagaggtgagcgaaacccagcatgggactattctgatcaaggtcgagtacaagggagaggacgtgccctgtaaaataccttttagtacggaagatggccagggtaaggcccacaatgggcgcttaattacagcaaacccagttgtgaccaaaaaggaggaaccggtcaatatcgaggctgaaccccctttcggcgagtccaacattgtgatcggaatcggcgacaacgccctgaaaattaattggtataag

SEQ ID NO: 1831 - RNA, 2025 nt, synthetic construct
  misc_feature 1..2025: note = derived and/or modified CDS sequence (opt3) from DENV-3 Consensus__SSc-prME
  source 1..2025: mol_type = other RNA
atgaccagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccagggtaaggctcataacgggcgtcttataaccgcgaatccagttgtgactaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggcctga

SEQ ID NO: 1832 - RNA, 2025 nt, synthetic construct
  misc_feature 1..2025: note = derived and/or modified CDS sequence (opt3) from DENV-3 Consensus__SSc-prME(F108S)
  source 1..2025: mol_type = other RNA
atgaccagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcagtggcaaggggtccctggtgacatgcgccaagttccaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttctacaaccgaggccatcctcccagaatatggaactcttggcctggagtgcagcccgcgaaccggtttggactttaatgagatgatcctactgacaatgaaaaacaaggcgtggatggtccatagacagtggttctttgatctccccctgccttggacctccggggccactacagaaacgccaacctggaataggaaagagcttctggtgactttcaagaacgcacacgctaaaaagcaagaagtagttgtgttgggctcacaggagggagccatgcacacagctctcaccggcgccacagaaattcagaatagtgggggaactagcatatttgcaggtcatctgaagtgtcggttaaaaatggacaagctggagctaaaaggcatgtcttacgccatgtgcaccaacacgttcgtcctcaagaaagaggtgtccgaaacccagcacgggacaatcctgattaaggtcgagtacaagggagaagatgtgccctgtaaaatccctttttcaactgaggacggccaaggtaaggctcataacgggcgtcttataaccgcgaatccagttgtgactaaaaaggaggaacccgtaaacattgaggcagaaccgcctttcggcgagagcaatatcgtcatcggaattggcgataacgccttgaaaatcaattggtataagaaggggagttctattggaaaaatgttcgaagctacagcccgcggtgcaagaaggatggccatactgggcgacaccgcttgggattttgggtccgtgggaggcgttctcaacagcctgggtaagatggtgcaccagatcttcgggtcggcctacacggcactgttttctggcgtctcctgggtgatgaaaattggaatcggcgtacttttgacatggatcgggctcaattcaaagaacaccagtatgagcttctcctgcattgcgataggaatcattactctgtatttaggcgctgtggttcaggcctga

SEQ ID NO: 1833 - RNA, 2025 nt, synthetic construct
  misc_feature 1..2025: note = derived and/or modified CDS sequence (opt3) from DENV-3 Consensus__SSc-prME(R186L)
  source 1..2025: mol_type = other RNA
atgaccagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgttgaccggtctagacttcaatgagatgatcctgctcacaatgaaaaacaaggcgtggatggtccatcgacagtggtttttcgatctgccccttccttggaccagcggggccactacagaaacgccaacctggaatagaaaagagctgttggtgacttttaagaacgcacacgctaaaaagcaagaagtagttgtgctcggctcccaggagggagccatgcacacagctctgaccggcgccacagaaattcaaaattcagggggaacaagtatattcgcaggtcatttaaagtgtaggctgaaaatggacaagctagagctcaaaggcatgagctacgccatgtgcaccaacacgtttgtcctgaagaaagaggtgtctgaaacccagcacgggacaatccttattaaggtcgagtacaagggagaagatgtgccctgtaaaatccctttctccactgaggacggccagggtaaggctcataacgggcggttgataaccgcgaatccagttgtgactaaaaaggaggaacccgtaaacattgaggcagaaccgcctttcggcgagtcaaatatcgtcatcggaattggcgataacgccctgaaaatcaattggtataagaaggggagcagtattggaaaaatgtttgaagctactgcccgtggtgcacgcagaatggccatactcggcgacaccgcttgggatttcgggtctgtgggaggcgttctgaactcccttggtaagatggtgcaccagatctttgggagcgcctacacggcactgttctcgggcgtctcttgggtgatgaaaattggaatcggcgtattgctcacatggatcgggttaaattccaagaacacctcaatgagttttagctgcattgcgataggaatcattactctgtatctgggcgctgtggttcaggcctga

SEQ ID NO: 1834 - RNA, 2025 nt, synthetic construct
  misc_feature 1..2025: note = derived and/or modified CDS sequence (opt3) from DENV-3 Consensus__SSc-prME(A265T)
  source 1..2025: mol_type = other RNA
atgaccagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcacaactgaaattcaaaattcagggggaaccagtatattcgccggtcatctgaagtgtcggttaaaaatggacaagctggagctaaaaggcatgagctacgcaatgtgcacgaacacctttgtcctcaagaaagaggtgtctgaaacacagcacgggactatcctgattaaggtcgagtacaagggagaagatgtgccctgtaaaatccctttctccaccgaggacggccagggtaaggcccataacgggcgtcttataacagctaatccagttgtgactaaaaaggaggaacccgtaaacattgaggcggaaccgcctttcggcgagtcaaatatcgtcatcggaattggcgataacgcattgaaaatcaattggtataagaaggggagcagtattggaaaaatgtttgaagccaccgctcgcggtgccagaaggatggcaatactgggcgacacggcctgggatttcgggtctgtgggaggcgttctcaactccctgggtaagatggtgcaccagatctttgggagcgcttacacagcccttttctcgggcgtctcttgggtgatgaaaattggaatcggcgtactgttgacctggatcgggctcaattccaagaacacttcaatgagttttagctgcattgcaataggaatcattacactgtatttaggcgcggtggttcaggcttga

SEQ ID NO: 1835 - RNA, 2025 nt, synthetic construct
  misc_feature 1..2025: note = derived and/or modified CDS sequence (opt3) from DENV-3 Consensus__SSc-prMEdelstem_TM-JEV
  source 1..2025: mol_type = other RNA
atgaccagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccagggtaaggctcataacgggcgtcttataaccgcgaatccagttgtgactaaaaaggaggaacccgtaaacattgaggcagaaccgcctttcggcgagtcaaatatcgtcatcggaattggcgataacgccttgaaaatcaattggtataagaaggggagcactctgggaaaggcttttagtaccacgctcaaaggtgcccagcgcctggcagcccttggcgacacagcttgggatttcgggtctattggaggcgtgtttaactccataggtagagccgttcaccaggtgttcgggggcgcatttaggaccctgttcggaggcatgagctggatcactcaggggttgatgggagcgctcctgttatggatgggcgtcaatgctcgggaccgatcgattgccctggcatttctagccacaggtggggtgctcgtattcctggctaccaacgtgcatgcctga

SEQ ID NO: 1836 - RNA, 1326 nt, synthetic construct
  misc_feature 1..1326: note = derived and/or modified CDS sequence (opt3) from DENV-3 Consensus__SSm-EdelTM
  source 1..1326: mol_type = other RNA
atgacccagaaggtggtcatcttcattctgctcatgcttgttacacccagcatgactatgagatgcgtgggcgtagggaacagggactttgtggagggactgtccggtgccacgtgggtcgatgtggttttggaacacggcgggtgtgtgaccacaatggctaaaaataagcctactttagacatagagctgcagaaaaccgaagcaacacagctagccaccctccggaagctgtgcatcgagggaaaaattactaacatcacaaccgattctcgctgtccaacgcagggcgaagcgactcttccggaggagcaggaccaaaattacgtctgcaagcatacctatgtggatcgaggttgggggaacggatgtggcctgttcggcaaggggtcattggtaacatgcgctaaatttcagtgtctcgaacccattgagggaaaggttgtgcagtacgaaaatctgaaatatactgtcatcataaccgtgcacacaggtgaccagcatcaagtgggcaacgagacccagggggtcacggccgagatcactcctcaggcaagtacaaccgaagccattctgccagagtacggaactctcggcttagaatgcagcccccgtacaggtctggatttcaatgagatgatccttttgaccatgaagaacaaggcttggatggttcacagacagtggtttttcgacctgcctctaccatggacgtccggggcaaccacagaaactcccacctggaataggaaagagctcctggtgacatttaagaacgcccatgctaaaaagcaagaggtagtggtccttggatctcaggaaggcgccatgcacactgcgctgaccggcgcaacagagattcaaaattcagggggaacctcgatcttcgccggtcacttgaaatgtcggctcaagatggataaactggaattaaagggcatgagctatgctatgtgcactaacacgtttgtgctgaaaaaggaggttagtgaaacacaacatgggaccatactcattaaggtggagtacaaaggagaggacgtcccttgtaagatcccattctccactgaagatggccagggtaaagcccacaatgggcgccttattaccgcaaacccggtggtaacaaagaaagaggaacccgttaatatcgaggctgaacctccatttggcgagtctaacatcgtgattggaataggcgacaacgccctgaagatcaattggtataagaaagggagctccattggaaagatgttcgaggcgaccgccagaggtgcaaggcggatggctatcttgggcgatactgcctgggactttgggtcatga

SEQ ID NO: 1837 - RNA, 2373 nt, synthetic construct
  misc_feature 1..2373: note = derived and/or modified CDS sequence (opt3) from DENV-3 Consensus__C-P2A-SSc-prME
  source 1..2373: mol_type = other RNA
atgaacaatcagagaaagaaaaccggcaagcccagcatcaacatgctgaaaagggtgcggaatcgcgtctccacagggtctcaactcgccaagcgattctcaaaaggacttctgaacggtcagggccctatgaagttggttatggcttttattgcattcttacgttttctggccataccaccgactgcgggggtgctagctagatggggaacgttcaagaaaagtggcgccatcaaggtactcaaaggttttaagaaagagattagcaatatgctgtccatcattaacaagaggaagaaaaatttcgaccttctgaagttggcaggggatgtggaatctaaccccggacctacctcgctctgcctgatgatgatcctgccagccgctctcgcatttcacttaacatcacgggacggcgagccccgcatgatagtcggcaaaaatgaaagagggaaaagcctgcttttcaaaactgccagtggaatcaacatgtgtaccttgattgctatggatctgggtgagatgtgcgacgatacagtgacctacaagtgtcctcatatcactgaagttgagccagaggacattgattgctggtgtaatctaacatccacctgggtgacgtatggcacttgcaaccaggccggggaacacaggcgggacaaacgctctgtcgcgctcgcaccccatgtgggaatgggcctggatacccgaacacagacttggatgagcgccgagggtgcttggagacaagtagaaaaggttgagacctgggcccttaggcaccctgggtttacaatcctggcattgttcctcgctcattacataggaacctccctgacgcagaaggtggtcatttttatcttactgatgctcgtgactccatcaatgacaatgcggtgtgtgggcgtcggcaatcgtgacttcgttgaggggcttagtggagccacctgggtggatgtagtgctggaacacggtggctgcgtcactacaatggcgaaaaacaagccgaccttggacattgagctacagaaaacggaagccacccagctggcaacactccgcaagctgtgtatcgaggggaaaatcactaatattaccacagatagcagatgccccactcaaggagaagctacccttcctgaggagcaggaccagaactatgtgtgtaagcacacatacgttgacaggggctggggtaacgggtgcggcctgtttggaaagggctctttggtgacctgcgccaaattccagtgtctcgaaccaatagaggggaaggtcgtgcaatatgaaaatctgaaatacactgtaatcattacggttcatacaggagatcagcaccaggtgggtaacgagacccaaggcgtcactgctgaaatcacaccccaggcctccaccaccgaggcaatattacctgagtatgggactctgggactagaatgctcaccacggacaggcctcgacttcaatgagatgattctgcttacgatgaagaacaaagcctggatggtgcatcgacagtggtttttcgatttgcccctgccgtggaccagcggtgctactacagaaacccctacatggaatcgcaaggagctcctggtcacttttaagaacgcgcacgcaaagaagcaggaagtggttgtgcttgggagtcaagagggcgccatgcacaccgctctgacgggagccaccgagatccaaaattctggcgggacatccatcttcgcaggacatttgaaatgtagactcaagatggacaaactggaattaaagggtatgagctacgccatgtgcactaacacctttgtactgaagaaagaggtctcggaaacacagcacggcactattctaatcaaggtggagtacaaaggggaggatgttccctgtaagattccattctctaccgaagacggacagggcaaagctcataatggtaggctcataacggccaaccctgtggtcacaaagaaagaggaacccgtgaatatcgaggcagaaccaccctttggggagtccaacattgtaatcggcatcggagataatgcgctgaagattaactggtataagaaaggctcaagtatagggaagatgttcgaggctaccgcccggggagcacgcagaatggccatccttggcgacactgcttgggattttggtagcgttgggggagtgttgaactccctgggcaaaatggtccaccagattttcggttctgcctacacagcactctttagcggcgtgtcatgggtgatgaagatcgggattggagtcctgttaacctggatcggcctgaatagtaaaaacacttccatgagcttctcttgcatagctatcgggattatcaccctttatttgggagccgttgtgcaggcgtga

SEQ ID NO: 1838 - RNA, 2037 nt, synthetic construct
  misc_feature 1..2037: note = derived and/or modified CDS sequence (opt3) from DENV-3 Consensus__SSopt-prME
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgcacacagctctcaccggcgccacagaaattcagaatagtgggggaacttcaatattcgcaggtcatctgaaatgtcgtttaaagatggacaaactggagctaaagggcatgagctacgccatgtgcaccaacacgtttgtcctcaagaaagaggtgtctgaaacccagcacgggacaatcctgattaaggtcgagtacaaaggagaagatgtgccctgtaagatccctttctccactgaggacggccaaggtaaagctcataacgggcgccttataaccgcgaatccagttgtgacaaagaaggaggaacccgtaaacattgaggcagaaccgcctttcggcgagtcaaatatcgtcatcggaattggcgataacgccttgaaaatcaattggtataagaaagggagcagtattggaaagatgtttgaagctactgccagaggtgcaaggcggatggccatactgggcgacaccgcttgggatttcgggtctgtgggaggcgttctcaactccctgggtaaaatggtgcaccagatctttgggagcgcctacacggcacttttctcgggcgtctcttgggtgatgaagattggaatcggcgtactgttgacatggatcgggctcaattccaagaacacctcaatgagttttagctgcattgcgataggaatcattactctgtatttaggcgctgtggttcaggcctga

SEQ ID NO: 1839 - RNA, 2037 nt, synthetic construct
  misc_feature 1..2037: note = derived and/or modified CDS sequence (opt3) from DENV-3 Consensus__SSopt-prME(F108S)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcagtggcaaggggtccctggtgacatgcgccaaattccaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttctacaaccgaggccatcctcccagaatatggaactcttggcctggagtgcagcccgagaaccggtttggactttaatgagatgatcctactgacaatgaagaacaaagcgtggatggtccataggcagtggttctttgatctccccctgccttggacctccggggccactacagaaacgccaacctggaatcggaaggagcttctggtgactttcaagaacgcacacgctaaaaagcaagaagtagttgtgttgggctcacaggagggagccatgcacacagctctcaccggcgccacagaaattcagaatagtgggggaactagcatatttgcaggtcatctgaaatgtcgtttaaagatggacaaactggagctaaagggcatgtcttacgccatgtgcaccaacacgttcgtcctcaagaaagaggtgtccgaaacccagcacgggacaatcctgattaaggtcgagtacaaaggagaagatgtgccctgtaagatccctttttcaactgaggacggccaaggtaaagctcataacgggcgccttataaccgcgaatccagttgtgacaaagaaggaggaacccgtaaacattgaggcagaaccgcctttcggcgagagcaatatcgtcatcggaattggcgataacgccttgaaaatcaattggtataagaaagggagttctattggaaagatgttcgaagctactgccagaggtgcaaggcggatggccatactgggcgacaccgcttgggattttgggtccgtgggaggcgttctcaacagcctgggtaaaatggtgcaccagatcttcgggtcggcctacacggcactgttttctggcgtctcctgggtgatgaagattggaatcggcgtacttttgacatggatcgggctcaattcaaagaacaccagtatgagcttctcctgcattgcgataggaatcattactctgtatttaggcgctgtggttcaggcctga

SEQ ID NO: 1840 - RNA, 2037 nt, synthetic construct
  misc_feature 1..2037: note = derived and/or modified CDS sequence (opt3) from DENV-3 Consensus__SSopt-prME(H27N)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagaatggcgggtgcgtgacgactatggcgaaaaacaagcccacactagacattgagctccagaaaaccgaagcaactcaactggccacacttcggaagctgtgtatcgagggaaagattaccaatatcacgaccgatagccgctgccctacacagggcgaagctactttgccagaggaacaggaccagaactatgtctgtaaacacacctacgttgatcgaggttgggggaatggatgcggcctcttcggcaaggggagtctggtgacatgcgccaaatttcaatgtttagagcccatagagggaaaggtagtgcagtatgaaaacctgaaatacactgtcattatcaccgtgcacacaggtgaccagcatcaggttggcaatgagacccaaggggtgactgcagaaattacgcctcaggcttccacaaccgaggccatcctcccagaatatggaactcttggcctggagtgctctccgagaaccggtttggacttcaacgagatgatcctactgacaatgaagaataaagcgtggatggtccacaggcagtggtttttcgatctccccctgccttggaccagcggggccactacagaaacgccaacctggaaccggaaggagcttctggtgacttttaagaatgcacatgctaaaaagcaagaagtagttgtgttgggctcccaggagggagccatgcacacagctctcaccggcgccacagaaattcagaactcagggggaaccagtatattcgcaggtcacctgaaatgtcgtttaaagatggacaaactggagctaaagggcatgagctacgccatgtgcactaacacgtttgtcctcaagaaagaggtgtctgaaacccagcatgggacaatcctgattaaggtcgagtacaaaggagaagatgtgccctgtaagatccctttctccactgaggacggccaaggtaaagctcacaatgggcgccttataaccgcgaacccagttgtgacaaagaaggaggaacccgtaaatattgaggcagaaccgcctttcggcgagtcaaacatcgtcatcggaattggcgataatgccttgaaaatcaactggtataagaaagggagcagtattggaaagatgtttgaagctactgccagaggtgcaaggcggatggccatactgggcgacaccgcttgggatttcgggtctgtgggaggcgttctcaattccctgggtaaaatggtgcatcagatctttgggagcgcctacacggcacttttctcgggcgtctcttgggtgatgaagattggaatcggcgtactgttgacatggatcgggctcaactccaagaatacctcaatgagttttagctgcattgcgataggaatcattactctgtatttaggcgctgtggttcaggcctga

SEQ ID NO: 1841 - RNA, 2037 nt, synthetic construct
  misc_feature 1..2037: note = derived and/or modified CDS sequence (opt3) from DENV-3 Consensus__SSopt-prME(T76I)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctatacagggcgaagctacattgccagaggaacaggaccagaattatgtctgtaaacacacttacgttgatcgaggttgggggaacggatgcggcctcttcggcaaggggagtctggtgacctgcgccaaatttcaatgtttagagcccattgagggaaaggtagtgcagtatgaaaatctgaaatacacagtcatcattactgtgcataccggtgaccagcaccaggttggcaacgagacacaaggggtgaccgcagaaatcactcctcaggcttccacgacagaggccatcctcccagaatatggaacccttggcctggagtgctctccgagaactggtttggacttcaatgagatgattctactgaccatgaagaacaaagcgtggatggtccataggcagtggtttttcgatctccccctgccttggacaagcggggccaccactgaaacaccaacgtggaatcggaaggagcttctggtgacctttaagaacgcacacgctaaaaagcaagaagtagttgtgttgggctcccaggagggagccatgcacactgctctcacaggcgccaccgaaatacaaaattcagggggaacaagtatcttcgcaggtcatctgaaatgtcgtttaaagatggacaaactggagctaaagggcatgagctacgccatgtgcactaacacctttgtcctcaagaaagaggtgtctgaaacgcagcacgggaccattctgatcaaggtcgagtacaaaggagaagatgtgccctgtaagatacctttctccacagaggacggccagggtaaagctcataacgggcgccttattactgcgaatccagttgtgaccaagaaggaggaacccgtaaacatcgaggcagaaccgcctttcggcgagtcaaatatcgtcattggaatcggcgataacgccttgaaaattaattggtataagaaagggagcagtataggaaagatgtttgaagctacagccagaggtgcaaggcggatggccatcctgggcgacactgcttgggatttcgggtctgtgggaggcgttctcaactccctgggtaaaatggtgcaccagatttttgggagcgcctacaccgcacttttctcgggcgtctcttgggtgatgaagatcggaatcggcgtactgttgacgtggattgggctcaattccaagaacacatcaatgagttttagctgcatagcgatcggaattatcaccctgtatttaggcgctgtggttcaggcctga

SEQ ID NO: 1842 - RNA, 2037 nt, synthetic construct
  misc_feature 1..2037: note = derived and/or modified CDS sequence (opt3) from DENV-3 Consensus__SSopt-prME(N89D)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccaggattatgtctgtaaacacacctacgttgaccgaggttgggggaatggatgcggcctcttcggcaaggggagtctggtgacatgcgccaaatttcaatgtttagagcccatagagggaaaggtagtgcagtatgaaaacctgaaatacactgtcattatcaccgtgcatacaggtgaccagcaccaggttggcaatgagacccaaggggtgactgcagaaattacgcctcaggcttccacaaccgaggccatcctcccagaatatggaactcttggcctggagtgctctccgagaaccggtttggatttcaacgagatgatcctactgacaatgaagaataaagcgtggatggtccataggcagtggtttttcgacctccccctgccttggaccagcggggccactacagaaacgccaacctggaaccggaaggagcttctggtgacttttaagaatgcacacgctaaaaagcaagaagtagttgtgttgggctcccaggagggagccatgcacacagctctcaccggcgccacagaaattcagaactcagggggaaccagtatattcgcaggtcatctgaaatgtcgtttaaagatggataaactggagctaaagggcatgagctacgccatgtgcactaatacgtttgtcctcaagaaagaggtgtctgaaacccagcacgggacaatcctgattaaggtcgagtacaaaggagaagacgtgccctgtaagatccctttctccactgaggatggccaaggtaaagctcataacgggcgccttataaccgcgaacccagttgtgacaaagaaggaggaacccgtaaatattgaggcagaaccgcctttcggcgagtcaaacatcgtcatcggaattggcgacaatgccttgaaaatcaactggtataagaaagggagcagtattggaaagatgtttgaagctactgccagaggtgcaaggcggatggccatactgggcgataccgcttgggacttcgggtctgtgggaggcgttctcaattccctgggtaaaatggtgcaccagatctttgggagcgcctacacggcacttttctcgggcgtctcttgggtgatgaagattggaatcggcgtactgttgacatggatcgggctcaactccaagaatacctcaatgagttttagctgcattgcgataggaatcattactctgtatttaggcgctgtggttcaggcctga

SEQ ID NO: 1843 - RNA, 2037 nt, synthetic construct
  misc_feature 1..2037: note = derived and/or modified CDS sequence (opt3) from DENV-3 Consensus__SSopt-prME(Y96H)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacccatgttgatcgaggttgggggaacggatgcggcctcttcggcaaggggagtctggtgacatgcgccaaatttcaatgtttagagcccatagagggaaaggtagtgcagtacgaaaatctgaaatatactgtcattatcaccgtgcacacaggtgaccagcatcaggttggcaacgagacccaaggggtgactgcagaaattacgcctcaggcttccacaaccgaggccatcctcccagaatacggaactcttggcctggagtgctctccgagaaccggtttggacttcaatgagatgatcctactgacaatgaagaacaaagcgtggatggtccacaggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgcatacagctctcaccggcgccacagaaattcagaatagtgggggaacttcaatattcgcaggtcacctgaaatgtcgtttaaagatggacaaactggagctaaagggcatgagctatgccatgtgcaccaacacgtttgtcctcaagaaagaggtgtctgaaacccagcatgggacaatcctgattaaggtcgagtacaaaggagaagatgtgccctgtaagatccctttctccactgaggacggccaaggtaaagctcacaacgggcgccttataaccgcgaatccagttgtgacaaagaaggaggaacccgtaaacattgaggcagaaccgcctttcggcgagtcaaatatcgtcatcggaattggcgataacgccttgaaaatcaattggtacaagaaagggagcagtattggaaagatgtttgaagctactgccagaggtgcaaggcggatggccatactgggcgacaccgcttgggatttcgggtctgtgggaggcgttctcaactccctgggtaaaatggtgcatcagatctttgggagcgcctatacggcacttttctcgggcgtctcttgggtgatgaagattggaatcggcgtactgttgacatggatcgggctcaattccaagaacacctcaatgagttttagctgcattgcgataggaatcattactctgtacttaggcgctgtggttcaggcctga

SEQ ID NO: 1844 - RNA, 2037 nt, synthetic construct
  misc_feature 1..2037: note = derived and/or modified CDS sequence (opt3) from DENV-3 Consensus__SSopt-prME(K110E)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcgaggggagtctggtgacatgcgccaagtttcaatgtttagagcccatagaaggaaaagtagtgcagtatgagaatctgaagtacactgtcattatcaccgtgcatacaggtgaccagcaccaggttggcaacgaaacccaaggggtgactgcagagattacgcctcaggcttccacaaccgaagccatcctcccagagtatggaactcttggcctggagtgctctccgagaaccggtttggacttcaatgaaatgatcctactgacaatgaaaaacaaggcgtggatggtccataggcagtggtttttcgatctccccctgccttggaccagcggggccactacagagacgccaacctggaatcggaaagaacttctggtgacttttaagaacgcacacgctaagaaacaagaggtagttgtgttgggctcccaggaaggagccatgcacacagctctcaccggcgccacagagattcaaaattcagggggaacaagtatattcgcaggtcatctgaagtgtcgtttaaaaatggacaagctggagctaaaaggcatgagctacgccatgtgcaccaacacgtttgtcctcaagaaggaagtgtctgagacccagcacgggacaatcctgattaaagtcgaatacaagggagaggatgtgccctgtaaaatccctttctccactgaggacggccagggtaaggctcataacgggcgccttataaccgcgaatccagttgtgactaaaaaggaggaacccgtaaacattgaagcagagccgcctttcggcgaatcaaatatcgtcatcggaattggcgataacgccttgaagatcaattggtataaaaaggggagcagtattggaaaaatgtttgaggctactgccagaggtgcaaggcggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggcctga

SEQ ID NO: 1845 - RNA, 2037 nt, synthetic construct
  misc_feature 1..2037: note = derived and/or modified CDS sequence (opt3) from DENV-3 Consensus__SSopt-prME(H149N)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagaaccaggttggcaatgagacccaaggggtgactgcagaaattacgcctcaggcttccacaaccgaggccatcctcccagaatatggaactcttggcctggagtgctctccgagaaccggtttggacttcaacgagatgatcctactgacaatgaagaataaagcgtggatggtccacaggcagtggtttttcgatctccccctgccttggaccagcggggccactacagaaacgccaacctggaaccggaaggagcttctggtgacttttaagaatgcacatgctaaaaagcaagaagtagttgtgttgggctcccaggagggagccatgcacacagctctcaccggcgccacagaaattcagaactcagggggaaccagtatattcgcaggtcacctgaaatgtcgtttaaagatggacaaactggagctaaagggcatgagctacgccatgtgcactaacacgtttgtcctcaagaaagaggtgtctgaaacccagcatgggacaatcctgattaaggtcgagtacaaaggagaagatgtgccctgtaagatccctttctccactgaggacggccaaggtaaagctcacaatgggcgccttataaccgcgaacccagttgtgacaaagaaggaggaacccgtaaatattgaggcagaaccgcctttcggcgagtcaaacatcgtcatcggaattggcgataatgccttgaaaatcaactggtataagaaagggagcagtattggaaagatgtttgaagctactgccagaggtgcaaggcggatggccatactgggcgacaccgcttgggatttcgggtctgtgggaggcgttctcaattccctgggtaaaatggtgcatcagatctttgggagcgcctacacggcacttttctcgggcgtctcttgggtgatgaagattggaatcggcgtactgttgacatggatcgggctcaactccaagaatacctcaatgagttttagctgcattgcgataggaatcattactctgtatttaggcgctgtggttcaggcctga

SEQ ID NO: 1846 - RNA, 2037 nt, synthetic construct
  misc_feature 1..2037: note = derived and/or modified CDS sequence (opt3) from DENV-3 Consensus__SSopt-prME(S184F)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgcttcccgagaaccggtttggactttaatgagatgatcctactgacaatgaagaacaaagcgtggatggtccataggcagtggttctttgatctccccctgccttggacctctggggccactacagaaacgccaacctggaatcggaaggagcttctggtgactttcaagaacgcacacgctaaaaagcaagaagtagttgtgttgggcagccaggagggagccatgcacacagctctcaccggcgccacagaaattcaaaattccgggggaacttcaatatttgcaggtcatctgaaatgtcgtttaaagatggacaaactggagctaaagggcatgagttacgccatgtgcaccaacacgttcgtcctcaagaaagaggtgagcgaaacccagcacgggacaatcctgattaaggtcgagtacaaaggagaagatgtgccctgtaagatccctttctctactgaggacggccagggtaaagctcataacgggcgccttataaccgcgaatccagttgtgacaaagaaggaggaacccgtaaacattgaggcagaaccgccttttggcgagtccaatatcgtcatcggaattggcgataacgccttgaaaatcaattggtataagaaagggtcaagcattggaaagatgttcgaagctactgccagaggtgcaaggcggatggccatactgggcgacaccgcttgggattttgggagtgtgggaggcgttctcaactctctgggtaaaatggtgcaccagatcttcgggtccgcctacacggcactttttagcggcgtctcgtgggtgatgaagattggaatcggcgtactgttgacatggatcgggctcaattctaagaacacctccatgtcattcagttgcattgcgataggaatcattactctgtatttaggcgctgtggttcaggcctga

SEQ ID NO: 1847 - RNA, 2037 nt, synthetic construct
  misc_feature 1..2037: note = derived and/or modified CDS sequence (opt3) from DENV-3 Consensus__SSopt-prME(R186L)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgttgaccggtctagacttcaatgagatgatcctgctcacaatgaagaacaaagcgtggatggtccatagacagtggtttttcgatctgccccttccttggaccagcggggccactacagaaacgccaacctggaataggaaggagctgttggtgacttttaagaacgcacacgctaaaaagcaagaagtagttgtgctcggctcccaggagggagccatgcacacagctctgaccggcgccacagaaattcagaatagtgggggaacttcaatattcgcaggtcatttaaaatgtcggctgaagatggacaaactagagctcaagggcatgagctacgccatgtgcaccaacacgtttgtcctgaagaaagaggtgtctgaaacccagcacgggacaatccttattaaggtcgagtacaaaggagaagatgtgccctgtaagatccctttctccactgaggacggccaaggtaaagctcataacgggcgtttgataaccgcgaatccagttgtgacaaagaaggaggaacccgtaaacattgaggcagaaccgcctttcggcgagtcaaatatcgtcatcggaattggcgataacgccctgaaaatcaattggtataagaaagggagcagtattggaaagatgtttgaagctactgcccgcggtgcaagaaggatggccatactcggcgacaccgcttgggatttcgggtctgtgggaggcgttctgaactcccttggtaaaatggtgcaccagatctttgggagcgcctacacggcactgttctcgggcgtctcttgggtgatgaagattggaatcggcgtattgctcacatggatcgggttaaattccaagaacacctcaatgagttttagctgcattgcgataggaatcattactctgtatctgggcgctgtggttcaggcctga

SEQ ID NO: 1848 - RNA, 2037 nt, synthetic construct
  misc_feature 1..2037: note = derived and/or modified CDS sequence (opt3) from DENV-3 Consensus__SSopt-prME(N240S)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagtccgcacacgctaaaaagcaagaagtagttgtgttgggctcacaggagggagccatgcacacagctctcaccggcgccacagaaattcagaacagtgggggaactagcatattcgcaggtcatctgaaatgtcgtttaaagatggacaaactggagctaaagggcatgtcttacgccatgtgcaccaatacgtttgtcctcaagaaagaggtgtccgaaacccagcacgggacaatcctgattaaggtcgagtacaaaggagaagatgtgccctgtaagatccctttctcaactgaggacggccaaggtaaagctcataacgggcgccttataaccgcgaacccagttgtgacaaagaaggaggaacccgtaaatattgaggcagaaccgcctttcggcgagagcaacatcgtcatcggaattggcgataatgccttgaaaatcaactggtataagaaagggagttctattggaaagatgtttgaagctactgccagaggtgcaaggcggatggccatactgggcgacaccgcttgggatttcgggtccgtgggaggcgttctcaatagcctgggtaaaatggtgcaccagatctttgggtcggcctacacggcacttttctctggcgtctcctgggtgatgaagattggaatcggcgtactgttgacatggatcgggctcaactcaaagaataccagtatgagcttttcctgcattgcgataggaatcattactctgtatttaggcgctgtggttcaggcctga

SEQ ID NO: 1849 - RNA, 2037 nt, synthetic construct
  misc_feature 1..2037: note = derived and/or modified CDS sequence (opt3) from DENV-3 Consensus__SSopt-prME(M258L)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccctccacacagctctgaccggcgccacagaaattcagaatagtgggggaacttcaatattcgcaggtcatttaaaatgtcgtctgaagatggacaaactagagctcaagggcatgagctacgccatgtgcaccaacacgtttgtcctgaagaaagaggtgtctgaaacccagcacgggacaatccttattaaggtcgagtacaaaggagaagatgtgccctgtaagatccctttctccactgaggacggccaaggtaaagctcataacgggcgcttgataaccgcgaatccagttgtgacaaagaaggaggaacccgtaaacattgaggcagaaccgcctttcggcgagtcaaatatcgtcatcggaattggcgataacgccctgaaaatcaattggtataagaaagggagcagtattggaaagatgtttgaagctactgccagaggtgcaaggcggatggccatactcggcgacaccgcttgggatttcgggtctgtgggaggcgttctgaactcccttggtaaaatggtgcaccagatctttgggagcgcctacacggcactgttctcgggcgtctcttgggtgatgaagattggaatcggcgtattgctcacatggatcgggttaaattccaagaacacctcaatgagttttagctgcattgcgataggaatcattactctgtatctgggcgctgtggttcaggcctga

SEQ ID NO: 1850 - RNA, 2037 nt, synthetic construct
  misc_feature 1..2037: note = derived and/or modified CDS sequence (opt3) from DENV-3 Consensus__SSopt-prME(H259N)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgaatacagctctcaccggcgccacagaaattcagaactcagggggaaccagtatattcgcaggtcacctgaaatgtcgtttaaagatggacaaactggagctaaagggcatgagctacgccatgtgcactaacacgtttgtcctcaagaaagaggtgtctgaaacccagcatgggacaatcctgattaaggtcgagtacaaaggagaagatgtgccctgtaagatccctttctccactgaggacggccaaggtaaagctcacaatgggcgccttataaccgcgaacccagttgtgacaaagaaggaggaacccgtaaatattgaggcagaaccgcctttcggcgagtcaaacatcgtcatcggaattggcgataatgccttgaaaatcaactggtataagaaagggagcagtattggaaagatgtttgaagctactgccagaggtgcaaggcggatggccatactgggcgacaccgcttgggatttcgggtctgtgggaggcgttctcaattccctgggtaaaatggtgcatcagatctttgggagcgcctacacggcacttttctcgggcgtctcttgggtgatgaagattggaatcggcgtactgttgacatggatcgggctcaactccaagaatacctcaatgagttttagctgcattgcgataggaatcattactctgtatttaggcgctgtggttcaggcctga

SEQ ID NO: 1851 - RNA, 2037 nt, synthetic construct
  misc_feature 1..2037: note = derived and/or modified CDS sequence (opt3) from DENV-3 Consensus__SSopt-prME(H259R)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgcgtacagctctcaccggcgccacagaaattcagaatagtgggggaacttcaatattcgcaggtcacctgaaatgtcgcttaaagatggacaaactggagctaaagggcatgagctacgccatgtgcaccaacacgtttgtcctcaagaaagaggtgtctgaaacccagcatgggacaatcctgattaaggtcgagtacaaaggagaagatgtgccctgtaagatccctttctccactgaggacggccaaggtaaagctcacaacgggagacttataaccgcgaatccagttgtgacaaagaaggaggaacccgtaaacattgaggcagaaccgcctttcggcgagtcaaatatcgtcatcggaattggcgataacgccttgaaaatcaattggtataagaaagggagcagtattggaaagatgtttgaagctactgccaggggtgcacggcgaatggccatactgggcgacaccgcttgggatttcgggtctgtgggaggcgttctcaactccctgggtaaaatggtgcatcagatctttgggagcgcctacacggcacttttctcgggcgtctcttgggtgatgaagattggaatcggcgtactgttgacatggatcgggctcaattccaagaacacctcaatgagttttagctgcattgcgataggaatcattactctgtatttaggcgctgtggttcaggcctga

SEQ ID NO: 1852 - RNA, 2037 nt, synthetic construct
  misc_feature 1..2037: note = derived and/or modified CDS sequence (opt3) from DENV-3 Consensus__SSopt-prME(A265T)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgcacacagctctcaccggcacaactgaaattcaaaattcagggggaaccagtatattcgccggtcatctgaaatgtcgtttaaagatggacaaactggagctaaagggcatgagctacgcaatgtgcacgaacacctttgtcctcaagaaagaggtgtctgaaacacagcacgggactatcctgattaaggtcgagtacaaaggagaagatgtgccctgtaagatccctttctccaccgaggacggccagggtaaagcccataacgggcgccttataacagctaatccagttgtgactaagaaggaggaacccgtaaacattgaggcggaaccgcctttcggcgagtcaaatatcgtcatcggaattggcgataacgcattgaaaatcaattggtataagaaagggagcagtattggaaagatgtttgaagccaccgctagaggtgccaggcggatggcaatactgggcgacacggcctgggatttcgggtctgtgggaggcgttctcaactccctgggtaaaatggtgcaccagatctttgggagcgcttacacagcccttttctcgggcgtctcttgggtgatgaagattggaatcggcgtactgttgacctggatcgggctcaattccaagaacacttcaatgagttttagctgcattgcaataggaatcattacactgtatttaggcgcggtggttcaggcttga

SEQ ID NO: 1853 - RNA, 2037 nt, synthetic construct
  misc_feature 1..2037: note = derived and/or modified CDS sequence (opt3) from DENV-3 Consensus__SSopt-prME(S296G)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgcacacagctctcaccggcgccacagaaattcagaatagtgggggaacttcaatattcgcaggtcatctgaaatgtcgtttaaagatggacaaactggagctaaagggcatggggtacgccatgtgcaccaacacgtttgtcctcaagaaagaggtgagcgaaacccagcacggaacaatcctgattaaggtcgagtacaaaggcgaagatgtgccctgtaagatccctttctctactgaggacggtcaagggaaagctcataacggccgccttataaccgcgaatccagttgtgacaaagaaggaggaacccgtaaacattgaggcagaaccgcctttcggagagtccaatatcgtcatcggcattggggataacgccttgaaaatcaattggtataagaaaggatcaagcattggtaagatgtttgaagctactgccagaggcgcaaggcggatggccatactgggggacaccgcttgggatttcggaagtgtgggcggtgttctcaactctctggggaaaatggtgcaccagatctttggctccgcctacacggcacttttcagcggagtctcgtgggtgatgaagattggcatcggggtactgttgacatggatcggactcaattctaagaacacctccatgtcatttagttgcattgcgataggcatcattactctgtatttaggtgctgtggttcaggcctga

SEQ ID NO: 1854 - RNA, 2037 nt, synthetic construct
  misc_feature 1..2037: note = derived and/or modified CDS sequence (opt3) from DENV-3 Consensus__SSopt-prME(S311R)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgcacacagctctcaccggcgccacagaaattcagaatagtgggggaacttcaatattcgcaggtcatctgaaatgtcgtttaaagatggacaaactggagctaaagggcatgagctacgccatgtgcaccaacacgtttgtcctcaagaaagaggtgcgcgaaacccagcacgggacaatcctgattaaggtcgagtacaaaggagaagatgtgccctgtaagatccctttctctactgaggacggccaaggtaaagctcataacgggagacttataaccgcgaatccagttgtgacaaagaaggaggaacccgtaaacattgaggcagaaccgcctttcggcgagtccaatatcgtcatcggaattggcgataacgccttgaaaatcaattggtataagaaagggtcaagcattggaaagatgtttgaagctactgccaggggtgcacggcgaatggccatactgggcgacaccgcttgggatttcgggagtgtgggaggcgttctcaactctctgggtaaaatggtgcaccagatctttgggtccgcctacacggcacttttcagcggcgtctcgtgggtgatgaagattggaatcggcgtactgttgacatggatcgggctcaattctaagaacacctccatgtcatttagttgcattgcgataggaatcattactctgtatttaggcgctgtggttcaggcctga

SEQ ID NO: 1855 - RNA, 2037 nt, synthetic construct
  misc_feature 1..2037: note = derived and/or modified CDS sequence (opt3) from DENV-3 Consensus__SSopt-prME(K321T)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgcacacagctctcaccggcgccacagaaattcagaatagtgggggaacttcaatattcgcaggtcatctgaaatgtcgtttaaagatggacaaactggagctaaagggcatgagctacgccatgtgcaccaacacgtttgtcctcaagaaagaggtgtctgaaacccagcacgggacaatcctgattactgtcgagtacaagggagaagatgtgccctgtaaaatccctttctccaccgaggacggccaaggtaaggctcataacgggcgccttataacagcgaatccagttgtgactaaaaaggaggaacccgtaaacattgaggcagaaccgcctttcggcgagtcaaatatcgtcatcggaattggcgataacgccttgaagatcaattggtataaaaaggggagcagtattggaaaaatgtttgaagctaccgccagaggtgcaaggcggatggccatactgggcgacacggcttgggatttcgggtctgtgggaggcgttctcaactccctgggtaagatggtgcaccagatctttgggagcgcctacacagcacttttctcgggcgtctcttgggtgatgaaaattggaatcggcgtactgttgacctggatcgggctcaattccaagaacacttcaatgagttttagctgcattgcgataggaatcattacactgtatttaggcgctgtggttcaggcctga

SEQ ID NO: 1856 - RNA, 2037 nt, synthetic construct
  misc_feature 1..2037: note = derived and/or modified CDS sequence (opt3) from DENV-3 Consensus__SSopt-prME(G28C,H242C)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcactgcggctgtgtgacgactatggcgaaaaataagcccacactagacattgagctccagaaaaccgaagcaactcaactggccacacttcggaagctgtgcatcgaggggaagattaccaacatcacgaccgatagccgctgtcctacacagggagaagctactttgccagaggaacaggaccagaattatgtctgcaaacacacctacgttgatcgaggctggggtaacgggtgcggactcttcggcaagggcagtctggtgacatgtgccaaatttcaatgcttagagcccatagaggggaaggtagtgcagtatgaaaatctgaaatacactgtcattatcaccgtgcatacaggagaccagcaccaggttggtaacgagacccaaggcgtgactgcagaaattacgcctcaggcttccacaaccgaggccatcctcccagaatatgggactcttggactggagtgttctccgagaaccggcttggacttcaatgagatgatcctactgacaatgaagaacaaagcgtggatggtccataggcagtggtttttcgatctccccctgccttggaccagcggtgccactacagaaacgccaacctggaatcggaaggagcttctggtgacttttaagaacgcatgcgctaaaaagcaagaagtagttgtgttggggtcccaggagggcgccatgcacacagctctcaccggagccacagaaattcagaatagtggcgggacttcaatattcgcaggacacctgaaatgtcgtttaaagatggacaaactggagctaaagggtatgagctacgccatgtgcaccaacacgtttgtcctcaagaaagaggtgtctgaaacccagcatggcacaatcctgattaaggtcgagtacaaaggggaagatgtgccctgtaagatccctttctccactgaggacggacaaggcaaagctcacaacggtcgccttataaccgcgaatccagttgtgacaaagaaggaggaacccgtaaacattgaggcagaaccgcctttcggggagtcaaatatcgtcatcggcattggagataacgccttgaaaatcaattggtataagaaaggcagcagtattgggaagatgtttgaagctactgccagaggagcaaggcggatggccatactgggtgacaccgcttgggatttcggctctgttgggggagtgctcaactccctgggcaaaatggtgcatcagatctttggtagcgcctacacggcacttttctcgggggtctcttgggtgatgaagattggcatcggagtactgttgacatggatcggcctcaattccaagaacacctcaatgagttttagctgcattgcgatagggatcattactctgtatttaggagctgtggttcaggcctga

SEQ ID NO: 1857 - RNA, 2037 nt, synthetic construct
  misc_feature 1..2037: note = derived and/or modified CDS sequence (opt3) from DENV-3 Consensus__SSopt-prME(R186L,A265T)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgttgaccggtctagacttcaatgagatgatcctgctcacaatgaagaacaaagcgtggatggtccatagacagtggtttttcgatctgccccttccttggaccagcggggccactacagaaacgccaacctggaataggaaggagctgttggtgacttttaagaacgcacacgctaaaaagcaagaagtagttgtgctcggctcccaggagggagccatgcacacagctctgaccggcacaactgaaattcaaaattcagggggaaccagtatattcgccggtcatttaaaatgtcggctgaagatggacaaactagagctcaagggcatgagctacgcaatgtgcacgaacacctttgtcctgaagaaagaggtgtctgaaacacagcacgggactatccttattaaggtcgagtacaaaggagaagatgtgccctgtaagatccctttctccaccgaggacggccagggtaaagcccataacgggcgtttgataacagctaatccagttgtgactaagaaggaggaacccgtaaacattgaggcggaaccgcctttcggcgagtcaaatatcgtcatcggaattggcgataacgcactgaaaatcaattggtataagaaagggagcagtattggaaagatgtttgaagccaccgctcgcggtgccagaaggatggcaatactcggcgacacggcctgggatttcgggtctgtgggaggcgttctgaactcccttggtaaaatggtgcaccagatctttgggagcgcttacacagccctgttctcgggcgtctcttgggtgatgaagattggaatcggcgtattgctcacctggatcgggttaaattccaagaacacttcaatgagttttagctgcattgcaataggaatcattacactgtatctgggcgcggtggttcaggcttga

SEQ ID NO: 1858 - RNA, 2037 nt, synthetic construct
  misc_feature 1..2037: note = derived and/or modified CDS sequence (opt3) from DENV-3 Consensus__SSopt-pr(D104A)ME(F108S)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgccaagagaagcgtagcacttgcaccccatgtgggcatgggtctggacacaaggacccaaacgtggatgtccgctgagggggcatggcggcaggtcgaaaaagtggagacttgggccttgcgccaccctggattcaccattctcgctctgtttctggcccattacatcggcacatctctcactcagaaggttgtgatattcatcttactgatgcttgtcaccccatcgatgacaatgagatgtgtgggcgtagggaacagggattttgttgaaggattgtcaggtgcgacctgggtggacgtcgtgctggagcacggcgggtgcgtgacgactatggccaaaaataagcccacactagatattgagctccagaaaaccgaagccactcaactggctacacttcggaagctgtgtatcgagggaaagattaccaacatcacgaccgacagccgctgccctacacagggcgaagccactttgccagaggaacaggatcagaattatgtctgtaaacacacctacgttgaccgaggttgggggaacggatgcggcctcagtggcaaggggtccctggtgacatgcgcaaaattccaatgtttagagcccatagagggaaaggtagtgcagtatgaaaatctgaaatacactgtcattatcaccgtgcatacaggtgatcagcaccaggttggcaacgagacccaaggggtgactgctgaaattacgcctcaggcctctacaaccgaggcgatcctcccagaatatggaactcttggcctggagtgcagcccgagaaccggtttggactttaatgagatgatcctactgacaatgaagaacaaagcctggatggtccataggcagtggttctttgacctccccctgccttggacctccggggcaactacagaaacgccaacctggaatcggaaggagcttctggtgactttcaagaacgctcacgccaaaaagcaagaagtagttgtgttgggctcacaggagggagctatgcacacagccctcaccggcgcaacagaaattcagaatagtgggggaactagcatatttgccggtcatctgaaatgtcgtttaaagatggataaactggagctaaagggcatgtcttacgctatgtgcaccaacacgttcgtcctcaagaaagaggtgtccgaaacccagcacgggacaatcctgattaaggtcgagtacaaaggagaagacgtgccctgtaagatccctttttcaactgaggatggccaaggtaaagcgcataacgggcgccttataaccgcaaatccagttgtgacaaagaaggaggaacccgtaaacattgaggccgaaccgcctttcggcgagagcaatatcgtcatcggaattggcgacaacgctttgaaaatcaattggtataagaaagggagttctattggaaagatgttcgaagccactgcaagaggtgccaggcggatggctatactgggcgataccgcctgggactttgggtccgtgggaggcgttctcaacagcctgggtaaaatggtgcaccagatcttcgggtcggcatacacggcgctgttttctggcgtctcctgggtgatgaagattggaatcggcgtacttttgacatggatcgggctcaattcaaagaacaccagtatgagcttctcctgcattgctataggaatcattactctgtatttaggcgccgtggttcaggcatga

SEQ ID NO: 1859 - RNA, 2037 nt, synthetic construct
  misc_feature 1..2037: note = derived and/or modified CDS sequence (opt3) from DENV-3 Consensus__SSopt-pr(D104A)ME(R186L,A265T)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgccaagagaagcgtagcacttgcaccccatgtgggcatgggtctggacacaaggacccaaacgtggatgtccgctgagggggcatggcggcaggtcgaaaaagtggagacttgggccttgcgccaccctggattcaccattctcgctctgtttctggcccattacatcggcacatctctcactcagaaggttgtgatattcatcttactgatgcttgtcaccccatcgatgacaatgagatgtgtgggcgtagggaacagggattttgttgaaggattgtcaggtgcgacctgggtggacgtcgtgctggagcacggcgggtgcgtgacgactatggccaaaaataagcccacactagatattgagctccagaaaaccgaagccactcaactggctacacttcggaagctgtgtatcgagggaaagattaccaacatcacgaccgacagccgctgccctacacagggcgaagccactttgccagaggaacaggatcagaattatgtctgtaaacacacctacgttgaccgaggttgggggaacggatgcggcctcttcggcaaggggagtctggtgacatgcgcaaaatttcaatgtttagagcccatagagggaaaggtagtgcagtatgaaaatctgaaatacactgtcattatcaccgtgcatacaggtgatcagcaccaggttggcaacgagacccaaggggtgactgctgaaattacgcctcaggcctccacaaccgaggcgatcctcccagaatatggaactcttggcctggagtgctctccgttgaccggtctagacttcaatgagatgatcctgctcacaatgaagaacaaagcctggatggtccatagacagtggtttttcgacctgccccttccttggaccagcggggcaactacagaaacgccaacctggaataggaaggagctgttggtgacttttaagaacgctcacgccaaaaagcaagaagtagttgtgctcggctcccaggagggagctatgcacacagccctgaccggcacaactgaaattcaaaattcagggggaaccagtatattcgcaggtcatttaaaatgtcggctgaagatggataaactagagctcaagggcatgagctacgccatgtgcacgaacacctttgtcctgaagaaagaggtgtctgaaacacagcacgggactatccttattaaggtcgagtacaaaggagaagacgtgccctgtaagatccctttctccaccgaggatggccagggtaaagctcataacgggcgtttgataacagcgaatccagttgtgactaagaaggaggaacccgtaaacattgaggcagaaccgcctttcggcgagtcaaatatcgtcatcggaattggcgacaacgccctgaaaatcaattggtataagaaagggagcagtattggaaagatgtttgaagctaccgcccgcggtgcaagaaggatggccatactcggcgatacggcttgggacttcgggtctgtgggaggcgttctgaactcccttggtaaaatggtgcaccagatctttgggagcgcctacacagcactgttctcgggcgtctcttgggtgatgaagattggaatcggcgtattgctcacctggatcgggttaaattccaagaacacttcaatgagttttagctgcattgcgataggaatcattacactgtatctgggcgctgtggttcaggcctga

SEQ ID NO: 1860 - RNA, 2037 nt, synthetic construct
  misc_feature 1..2037: note = derived and/or modified CDS sequence (opt3) from DENV-3 Consensus__SSopt-pr(D104A)ME(F108S,R186L,A265T)
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgccaagagaagcgtagcacttgcaccccatgtgggcatgggtctggacacaaggacccaaacgtggatgtccgctgagggggcatggcggcaggtcgaaaaagtggagacttgggccttgcgccaccctggattcaccattctcgctctgtttctggcccattacatcggcacatctctcactcagaaggttgtgatattcatcttactgatgcttgtcaccccatcgatgacaatgagatgtgtgggcgtagggaacagggattttgttgaaggattgtcaggtgcgacctgggtggacgtcgtgctggagcacggcgggtgcgtgacgactatggccaaaaataagcccacactagatattgagctccagaaaaccgaagccactcaactggctacacttcggaagctgtgtatcgagggaaagattaccaacatcacgaccgacagccgctgccctacacagggcgaagccactttgccagaggaacaggatcagaattatgtctgtaaacacacctacgttgaccgaggttgggggaacggatgcggcctcagtggcaaggggtccctggtgacatgcgcaaaattccaatgtttagagcccatagagggaaaggtagtgcagtatgaaaatctgaaatacactgtcattatcaccgtgcatacaggtgatcagcaccaggttggcaacgagacccaaggggtgactgctgaaattacgcctcaggcctctacaaccgaggcgatcctcccagaatatggaactcttggcctggagtgcagcccgttgaccggtctagactttaatgagatgatcctgctcacaatgaagaacaaagcctggatggtccatagacagtggttctttgacctgccccttccttggacctccggggcaactacagaaacgccaacctggaataggaaggagctgttggtgactttcaagaacgctcacgccaaaaagcaagaagtagttgtgctcggctcacaggagggagctatgcacacagccctgaccggcacaactgaaattcagaatagtgggggaaccagcatatttgcaggtcatttaaaatgtcggctgaagatggataaactagagctcaagggcatgtcttacgccatgtgcacgaacaccttcgtcctgaagaaagaggtgtccgaaacacagcacgggactatccttattaaggtcgagtacaaaggagaagacgtgccctgtaagatccctttttcaaccgaggatggccaaggtaaagctcataacgggcgtttgataacagcgaatccagttgtgactaagaaggaggaacccgtaaacattgaggcagaaccgcctttcggcgagagcaatatcgtcatcggaattggcgacaacgccctgaaaatcaattggtataagaaagggagttctattggaaagatgttcgaagctaccgcccgcggtgcaagaaggatggccatactcggcgatacggcttgggactttgggtccgtgggaggcgttctgaacagccttggtaaaatggtgcaccagatcttcgggtcggcctacacagcactgttttctggcgtctcctgggtgatgaagattggaatcggcgtattgctcacctggatcgggctgaatagtaagaacacttcaatgagcttctcctgcattgcgataggaatcattacattatatctgggcgctgtggttcaggcctga

SEQ ID NO: 1861 - RNA, 2016 nt, synthetic construct
  misc_feature 1..2016: note = derived and/or modified CDS sequence (opt3) from DENV-3 Consensus__SSopt-prMEdel101-107,(R99P,F108N)
  source 1..2016: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcccggtaacgggaagggaagtctcgtgacatgcgccaaattccaatgcctggagcctatagagggcaaggtagtgcagtatgaaaatttaaaatacactgtcattatcaccgtgcatacaggcgaccagcaccaggttgggaacgagacccaaggagtgactgcagaaattacgccacaggcttccacaaccgaggccatcctgccggaatatggtactctcggccttgagtgttctccccgaaccgggctggactttaatgagatgatcttgctaacaatgaagaacaaagcgtggatggtccatagacagtggttctttgatctgcctctcccatggaccagcggagccactacagaaacgcccacctggaataggaaggagctgcttgtgactttcaagaacgcacacgctaaaaagcaagaagtagttgtgctgggctcccaggagggtgccatgcacacagctttgaccggggccacagaaattcagaatagtggcggaacttcaatatttgcaggccatctcaaatgccggctgaagatggacaaattagagctgaaggggatgagctacgccatgtgtaccaacacgttcgtcctaaagaaagaggtgtctgaaacccagcacggaacaatcctcattaaggtcgagtacaaaggtgaagatgtgccttgcaagatcccattttccactgaggacggccaagggaaagctcataacggacgtctgataaccgcgaatcccgttgtgacaaagaaggaggaaccggtaaacattgaggcagaacctcccttcggcgagtcaaatatcgtcatcggtattggggataacgcccttaaaatcaattggtataagaaaggcagcagtattggaaagatgttcgaagctactgcccgcggcgcaagaaggatggccatattgggggacaccgcttgggattttggatctgtgggtggcgttctgaactccctcgggaaaatggtgcaccagatcttcggaagcgcctacacggcactgttttcgggcgtctcttgggtgatgaagattggtatcggggtacttctgacatggatcggcctcaattccaagaacacctcaatgagtttcagctgtattgcgataggaatcattactttgtatctgggcgctgtggttcaggcctga

SEQ ID NO: 1862 - RNA, 2037 nt, synthetic construct
  misc_feature 1..2037: note = derived and/or modified CDS sequence (opt3) from DENV-3 Consensus__SSopt-prMEdelstem_TM-JEV
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgcacacagctctcaccggcgccacagaaattcagaatagtgggggaacttcaatattcgcaggtcatctgaaatgtcgtttaaagatggacaaactggagctaaagggcatgagctacgccatgtgcaccaacacgtttgtcctcaagaaagaggtgtctgaaacccagcacgggacaatcctgattaaggtcgagtacaaaggagaagatgtgccctgtaagatccctttctccactgaggacggccaaggtaaagctcataacgggcgccttataaccgcgaatccagttgtgacaaagaaggaggaacccgtaaacattgaggcagaaccgcctttcggcgagtcaaatatcgtcatcggaattggcgataacgccttgaaaatcaattggtataagaaagggagcactctgggaaaggcttttagtaccacgctcaaaggtgcccagagactggcagcccttggcgacacagcttgggatttcgggtctattggaggcgtgtttaactccataggtagggccgttcaccaggtgttcgggggcgcatttcggaccctgttcggaggcatgagctggatcactcaggggttgatgggagcgctcctgttatggatgggcgtcaatgctcgagaccgctcgattgccctggcatttctagccacaggtggggtgctcgtattcctggctaccaacgtgcatgcctga

SEQ ID NO: 1863 - RNA, 2037 nt, synthetic construct
  misc_feature 1..2037: note = derived and/or modified CDS sequence (opt3) from DENV-3 Consensus__SSopt-pr(D104A)MEdelstem_TM,(F108S)-JEV
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgccaagagaagcgtagcacttgcaccccatgtgggcatgggtctggacacaaggacccaaacgtggatgtccgctgagggggcatggcggcaggtcgaaaaagtggagacttgggccttgcgccaccctggattcaccattctcgctctgtttctggcccattacatcggcacatctctcactcagaaggttgtgatattcatcttactgatgcttgtcaccccatcgatgacaatgagatgtgtgggcgtagggaacagggattttgttgaaggattgtcaggtgcgacctgggtggacgtcgtgctggagcacggcgggtgcgtgacgactatggccaaaaataagcccacactagatattgagctccagaaaaccgaagccactcaactggctacacttcggaagctgtgtatcgagggaaagattaccaacatcacgaccgacagccgctgccctacacagggcgaagccactttgccagaggaacaggatcagaattatgtctgtaaacacacctacgttgaccgaggttgggggaacggatgcggcctcagtggcaaggggtccctggtgacatgcgcaaaattccaatgtttagagcccatagagggaaaggtagtgcagtatgaaaatctgaaatacactgtcattatcaccgtgcatacaggtgatcagcaccaggttggcaacgagacccaaggggtgactgctgaaattacgcctcaggcctctacaaccgaggcgatcctcccagaatatggaactcttggcctggagtgcagcccgagaaccggtttggactttaatgagatgatcctactgacaatgaagaacaaagcctggatggtccataggcagtggttctttgacctccccctgccttggacctccggggcaactacagaaacgccaacctggaatcggaaggagcttctggtgactttcaagaacgctcacgccaaaaagcaagaagtagttgtgttgggctcacaggagggagctatgcacacagccctcaccggcgcaacagaaattcagaatagtgggggaactagcatatttgccggtcatctgaaatgtcgtttaaagatggataaactggagctaaagggcatgtcttacgctatgtgcaccaacacgttcgtcctcaagaaagaggtgtccgaaacccagcacgggacaatcctgattaaggtcgagtacaaaggagaagacgtgccctgtaagatccctttttcaactgaggatggccaaggtaaagcgcataacgggcgccttataaccgcaaatccagttgtgacaaagaaggaggaacccgtaaacattgaggccgaaccgcctttcggcgagagcaatatcgtcatcggaattggcgacaacgctttgaaaatcaattggtataagaaagggagtactctgggaaaggccttctctaccacgctcaaaggtgcacagagactggccgctcttggcgatacagcctgggactttgggtccattggaggcgtgttcaacagcataggtagggcagttcaccaggtgtttgggggcgcgttccggaccctgtttggaggcatgtcgtggatcactcaggggttgatgggagctctcctgttatggatgggcgtcaatgcccgagatcgctctattgcactggccttcctagctacaggtggggtgctcgtatttctggccaccaacgtgcatgcatga

SEQ ID NO: 1864 - RNA, 2037 nt, synthetic construct
  misc_feature 1..2037: note = derived and/or modified CDS sequence (opt3) from DENV-3 Consensus__SSopt-pr(D104A)MEdelstem_TM,(R186L,A265T)-JEV
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgccaagagaagcgtagcacttgcaccccatgtgggcatgggtctggacacaaggacccaaacgtggatgtccgctgagggggcatggcggcaggtcgaaaaagtggagacttgggccttgcgccaccctggattcaccattctcgctctgtttctggcccattacatcggcacatctctcactcagaaggttgtgatattcatcttactgatgcttgtcaccccatcgatgacaatgagatgtgtgggcgtagggaacagggattttgttgaaggattgtcaggtgcgacctgggtggacgtcgtgctggagcacggcgggtgcgtgacgactatggccaaaaataagcccacactagatattgagctccagaaaaccgaagccactcaactggctacacttcggaagctgtgtatcgagggaaagattaccaacatcacgaccgacagccgctgccctacacagggcgaagccactttgccagaggaacaggatcagaattatgtctgtaaacacacctacgttgaccgaggttgggggaacggatgcggcctcttcggcaaggggagtctggtgacatgcgcaaaatttcaatgtttagagcccatagagggaaaggtagtgcagtatgaaaatctgaaatacactgtcattatcaccgtgcatacaggtgatcagcaccaggttggcaacgagacccaaggggtgactgctgaaattacgcctcaggcctccacaaccgaggcgatcctcccagaatatggaactcttggcctggagtgctctccgttgaccggtctagacttcaatgagatgatcctgctcacaatgaagaacaaagcctggatggtccatagacagtggtttttcgacctgccccttccttggaccagcggggcaactacagaaacgccaacctggaataggaaggagctgttggtgacttttaagaacgctcacgccaaaaagcaagaagtagttgtgctcggctcccaggagggagctatgcacacagccctgaccggcacaactgaaattcaaaattcagggggaaccagtatattcgcaggtcatttaaaatgtcggctgaagatggataaactagagctcaagggcatgagctacgccatgtgcacgaacacctttgtcctgaagaaagaggtgtctgaaacacagcacgggactatccttattaaggtcgagtacaaaggagaagacgtgccctgtaagatccctttctccaccgaggatggccagggtaaagctcataacgggcgtttgataacagcgaatccagttgtgactaagaaggaggaacccgtaaacattgaggcagaaccgcctttcggcgagtcaaatatcgtcatcggaattggcgacaacgccctgaaaatcaattggtataagaaagggagcaccctcggaaaggcttttagtacgacactgaaaggtgcccagcgccttgcagccctgggcgataccgcttgggacttcgggtctattggaggcgtgtttaactccataggtagagccgttcaccaggtgttcgggggcgcatttaggactttgttcggaggcatgagctggatcacacaggggctcatgggagcgctgttactgtggatgggcgtcaatgctcgggatcgatcgattgccctagcatttctcgccaccggtggggtgctggtattccttgctactaacgtgcatgcctga

SEQ ID NO: 1865 - RNA, 2037 nt, synthetic construct
  misc_feature 1..2037: note = derived and/or modified CDS sequence (opt3) from DENV-3 Consensus__SSopt-pr(D104A)MEdelstem_TM,(F108S,R186L,A265T)- JEV
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgccaagagaagcgtagcacttgcaccccatgtgggcatgggtctggacacaaggacccaaacgtggatgtccgctgagggggcatggcggcaggtcgaaaaagtggagacttgggccttgcgccaccctggattcaccattctcgctctgtttctggcccattacatcggcacatctctcactcagaaggttgtgatattcatcttactgatgcttgtcaccccatcgatgacaatgagatgtgtgggcgtagggaacagggattttgttgaaggattgtcaggtgcgacctgggtggacgtcgtgctggagcacggcgggtgcgtgacgactatggccaaaaataagcccacactagatattgagctccagaaaaccgaagccactcaactggctacacttcggaagctgtgtatcgagggaaagattaccaacatcacgaccgacagccgctgccctacacagggcgaagccactttgccagaggaacaggatcagaattatgtctgtaaacacacctacgttgaccgaggttgggggaacggatgcggcctcagtggcaaggggtccctggtgacatgcgcaaaattccaatgtttagagcccatagagggaaaggtagtgcagtatgaaaatctgaaatacactgtcattatcaccgtgcatacaggtgatcagcaccaggttggcaacgagacccaaggggtgactgctgaaattacgcctcaggcctctacaaccgaggcgatcctcccagaatatggaactcttggcctggagtgcagcccgttgaccggtctagactttaatgagatgatcctgctcacaatgaagaacaaagcctggatggtccatagacagtggttctttgacctgccccttccttggacctccggggcaactacagaaacgccaacctggaataggaaggagctgttggtgactttcaagaacgctcacgccaaaaagcaagaagtagttgtgctcggctcacaggagggagctatgcacacagccctgaccggcacaactgaaattcagaatagtgggggaaccagcatatttgcaggtcatttaaaatgtcggctgaagatggataaactagagctcaagggcatgtcttacgccatgtgcacgaacaccttcgtcctgaagaaagaggtgtccgaaacacagcacgggactatccttattaaggtcgagtacaaaggagaagacgtgccctgtaagatccctttttcaaccgaggatggccaaggtaaagctcataacgggcgtttgataacagcgaatccagttgtgactaagaaggaggaacccgtaaacattgaggcagaaccgcctttcggcgagagcaatatcgtcatcggaattggcgacaacgccctgaaaatcaattggtataagaaagggagtaccctcggaaaggctttctctacgacactgaaaggtgcccagcgccttgcagccctgggcgataccgcttgggactttgggtccattggaggcgtgttcaacagcataggtagagccgttcaccaggtgtttgggggcgcattcaggactttgtttggaggcatgtcgtggatcacacaggggctcatgggagcgctgttactgtggatgggcgtcaatgctcgggatcgatctattgccctagcattcctcgccaccggtggggtgctggtatttcttgctactaacgtgcatgcctga

SEQ ID NO: 1866 - RNA, 2037 nt, synthetic construct
  misc_feature 1..2037: note = derived and/or modified CDS sequence (opt3) from DENV-3 Consensus__SSopt-prMEdelstem_TM,(H259N)-JEV
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgagaaccggtttggacttcaatgagatgatcctactgacaatgaagaacaaagcgtggatggtccataggcagtggtttttcgatctccccctgccttggaccagcggggccactacagaaacgccaacctggaatcggaaggagcttctggtgacttttaagaacgcacacgctaaaaagcaagaagtagttgtgttgggctcccaggagggagccatgaatacagctctcaccggcgccacagaaattcagaactcagggggaaccagtatattcgcaggtcacctgaaatgtcgtttaaagatggacaaactggagctaaagggcatgagctacgccatgtgcactaacacgtttgtcctcaagaaagaggtgtctgaaacccagcatgggacaatcctgattaaggtcgagtacaaaggagaagatgtgccctgtaagatccctttctccactgaggacggccaaggtaaagctcacaatgggcgccttataaccgcgaacccagttgtgacaaagaaggaggaacccgtaaatattgaggcagaaccgcctttcggcgagtcaaacatcgtcatcggaattggcgataatgccttgaaaatcaactggtataagaaagggagcactctgggaaaggcttttagtaccacgctcaaaggtgcccagagactggcagcccttggcgacacagcttgggatttcgggtctattggaggcgtgtttaattccataggtagggccgttcatcaggtgttcgggggcgcatttcggaccctgttcggaggcatgagctggatcactcaggggttgatgggagcgctcctgttatggatgggcgtcaacgctcgagaccgctcgattgccctggcatttctagccacaggtggggtgctcgtattcctggctaccaatgtgcacgcctga

SEQ ID NO: 1867 - RNA, 2037 nt, synthetic construct
  misc_feature 1..2037: note = derived and/or modified CDS sequence (opt3) from DENV-3 Consensus__SSopt-prMEdelstem_TM,(R186L,A265T)-JEV
  source 1..2037: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcgaggttgggggaacggatgcggcctcttcggcaaggggagtctggtgacatgcgccaaatttcaatgtttagagcccatagagggaaaggtagtgcagtatgaaaatctgaaatacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgttgaccggtctagacttcaatgagatgatcctgctcacaatgaagaacaaagcgtggatggtccatagacagtggtttttcgatctgccccttccttggaccagcggggccactacagaaacgccaacctggaataggaaggagctgttggtgacttttaagaacgcacacgctaaaaagcaagaagtagttgtgctcggctcccaggagggagccatgcacacagctctgaccggcacaactgaaattcaaaattcagggggaaccagtatattcgccggtcatttaaaatgtcggctgaagatggacaaactagagctcaagggcatgagctacgcaatgtgcacgaacacctttgtcctgaagaaagaggtgtctgaaacacagcacgggactatccttattaaggtcgagtacaaaggagaagatgtgccctgtaagatccctttctccaccgaggacggccagggtaaagcccataacgggcgtttgataacagctaatccagttgtgactaagaaggaggaacccgtaaacattgaggcggaaccgcctttcggcgagtcaaatatcgtcatcggaattggcgataacgcactgaaaatcaattggtataagaaagggagcaccctcggaaaggcctttagtacgacactgaaaggtgctcagcgccttgccgcactgggcgacaccgcctgggatttcgggtctattggaggcgtgtttaactccataggtagagctgttcaccaggtgttcgggggcgcctttaggactttgttcggaggcatgagctggatcacacaggggctcatgggagcactgttactgtggatgggcgtcaatgcgcgggaccgatcgattgctctagcctttctcgcaaccggtggggtgctggtattccttgccactaacgtgcatgcttga

SEQ ID NO: 1868 - RNA, 2016 nt, synthetic construct
  misc_feature 1..2016: note = derived and/or modified CDS sequence (opt3) from DENV-3 Consensus__SSopt-prMEdelstem_TM,del101-107,(R99P,F108N)-JEV
  source 1..2016: mol_type = other RNA
atgaagaggaaaaagaccagcctgtgcctcatgatgatccttcccgccgctctggcattccacttgacatccagagacggcgagcctcggatgattgtggggaaaaacgaacgcggaaagtctttactgtttaaaactgcctcaggtataaatatgtgtacgctaatcgcgatggatctcggcgagatgtgcgacgataccgtcacatacaagtgtccacatattactgaagttgagccggaagacatcgattgctggtgtaacctgaccagtacatgggtgacctatgggacttgcaatcaggctggagagcaccgacgtgacaagagaagcgtagcccttgcaccccatgtgggcatgggtctggatacaaggacccaaacgtggatgtccgccgagggggcttggcggcaggtcgaaaaagtggagacttgggcattgcgccaccctggattcaccattctcgccctgtttctggctcattacatcggcacatctctcactcagaaggttgtgatattcatcttactgatgcttgtcaccccatcgatgacaatgagatgtgtgggcgtagggaacagggactttgttgaaggattgtcaggtgccacctgggtggatgtcgtgctggagcacggcgggtgcgtgacgactatggcgaaaaataagcccacactagacattgagctccagaaaaccgaagcaactcaactggccacacttcggaagctgtgtatcgagggaaagattaccaacatcacgaccgatagccgctgccctacacagggcgaagctactttgccagaggaacaggaccagaattatgtctgtaaacacacctacgttgatcccggtaacgggaagggaagtctcgtgacatgcgccaaattccaatgcctggagcctatagagggcaaggtagtgcagtatgaaaatttaaaatacactgtcattatcaccgtgcatacaggcgaccagcaccaggttgggaacgagacccaaggagtgactgcagaaattacgccacaggcttccacaaccgaggccatcctgccggaatatggtactctcggccttgagtgttctccccgaaccgggctggactttaatgagatgatcttgctaacaatgaagaacaaagcgtggatggtccatagacagtggttctttgatctgcctctcccatggaccagcggagccactacagaaacgcccacctggaataggaaggagctgcttgtgactttcaagaacgcacacgctaaaaagcaagaagtagttgtgctgggctcccaggagggtgccatgcacacagctttgaccggggccacagaaattcagaatagtggcggaacttcaatatttgcaggccatctcaaatgccggctgaagatggacaaattagagctgaaggggatgagctacgccatgtgtaccaacacgttcgtcctaaagaaagaggtgtctgaaacccagcacggaacaatcctcattaaggtcgagtacaaaggtgaagatgtgccttgcaagatcccattttccactgaggacggccaagggaaagctcataacggacgtctgataaccgcgaatcccgttgtgacaaagaaggaggaaccggtaaacattgaggcagaacctcccttcggcgagtcaaatatcgtcatcggtattggggataacgcccttaaaatcaattggtataagaaaggcagcactttgggaaaggctttcagtaccacgctgaaaggcgcccagcgcctcgcagccctgggggacacagcttgggattttggatctattggtggcgtgttcaactccatagggagagccgttcaccaggtgtttggaggcgcattcaggaccctttttggtgggatgagctggatcactcagggcctgatgggagcgttgctcctgtggatgggcgtcaatgctcgggaccgatcgattgccttagcattcctggccacagggggagtgctagtatttctcgctaccaacgtgcatgcctga

SEQ ID NO: 1869 - RNA, 3081 nt, synthetic construct
  misc_feature 1..3081: note = derived and/or modified CDS sequence (opt3) from DENV-3 Consensus__SSc-prME-NS1
  source 1..3081: mol_type = other RNA
atgaccagcctgtgcctcatgatgatccttcccgccgctctggcattccacttgacatccagagacggcgagcctaggatgattgtggggaagaacgaacggggaaaatctttactgtttaagactgcctcaggtataaatatgtgtacgctaatcgcgatggatctcggcgagatgtgcgacgataccgtcacatacaaatgtccacatattactgaagttgagccggaagacatcgattgctggtgtaacctgaccagtacatgggtgacctatgggacttgcaatcaggctggagagcaccgccgagacaagcgtagcgtagcccttgcaccccatgtgggcatgggtctggatacaagaacccaaacgtggatgtccgccgagggggcttggaggcaggtcgaaaaagtggagacttgggcattgcggcaccctggattcaccattctcgccctgtttctggctcattacatcggcacatctctcactcagaaggttgtgatattcatcttactgatgcttgtcaccccatcgatgacaatgcgctgtgtgggcgtagggaacagagactttgttgaaggattgtcaggtgccacctgggtggatgtcgtgctggagcacggcgggtgcgtgacgactatggcgaagaataaacccacactagacattgagctccagaagaccgaagcaactcaactggccacacttaggaaactgtgtatcgagggaaagattaccaacatcacgaccgatagccggtgccctacacagggcgaagctactttgccagaggaacaggaccagaattatgtctgtaaacacacctacgttgatcgcggttgggggaacggatgcggcctcttcggcaaggggagtctggtgacatgcgccaagtttcaatgtttagagcccatagagggaaaagtagtgcagtatgaaaatctgaagtacactgtcattatcaccgtgcatacaggtgaccagcaccaggttggcaacgagacccaaggggtgactgcagaaattacgcctcaggcttccacaaccgaggccatcctcccagaatatggaactcttggcctggagtgctctccgcgaaccggtttggacttcaatgagatgatcctactgacaatgaaaaacaaggcgtggatggtccatagacagtggtttttcgatctccccctgccttggaccagcggggccactacagaaacgccaacctggaataggaaagagcttctggtgacttttaagaacgcacacgctaaaaagcaagaagtagttgtgttgggctcccaggagggagccatgcacacagctctcaccggcgccacagaaattcaaaattcagggggaacaagtatattcgcaggtcatctgaagtgtcggttaaaaatggacaagctggagctaaaaggcatgagctacgccatgtgcaccaacacgtttgtcctcaagaaagaggtgtctgaaacccagcacgggacaatcctgattaaggtcgagtacaagggagaagatgtgccctgtaaaatccctttctccactgaggacggccagggtaaggctcataacgggcgtcttataaccgcgaatccagttgtgactaaaaaggaggaacccgtaaacattgaggcagaaccgcctttcggcgagtcaaatatcgtcatcggaattggcgataacgccttgaaaatcaattggtataagaaggggagcagtattggaaaaatgtttgaagctactgcccgcggtgcaagaaggatggccatactgggcgacaccgcttgggatttcgggtctgtgggaggcgttctcaactccctgggtaagatggtgcaccagatctttgggagcgcctacacggcacttttctcgggcgtctcttgggtgatgaaaattggaatcggcgtactgttgacatggatcgggctcaattccaagaacacctcaatgagttttagctgcattgcgataggaatcattactctgtatttaggcgctgtggttcaggccgacatgggttgtgtcatcaattggaaagggaaggagctgaagtgcggatccggcattttcgtgacaaacgaggtgcatacctggactgaacagtacaaatttcaagcagattctcccaagcggctagccaccgctatcgccggtgcatgggagaatggcgtctgtgggatacgaagcacaacgcgcatggaaaacctcctgtggaaacagatcgctaatgagcttaactatattttgtgggaaaataacatcaagctgaccgttgtggtgggagacattatcggcgtactcgagcaggggaaaagaactctgacaccacagcctatggagttaaagtactcatggaaaacctggggaaaggccaagatagtcacagcggaaactcaaaacagttccttcattatcgatggccccaataccccagagtgccccagcgtgtctagggcctggaacgtttgggaagtggaggactatggttttggggtcttcacgacaaatatttggctgaaacttcgggaagtgtacacccagttgtgtgaccaccgcctcatgtcagctgcagttaaggatgagagagccgtgcacgctgacatgggatactggatcgagagtcagaaaaacggcagctggaagctggaaaaagcctccctaatagaggtaaagacttgcacctggcctaagtctcatacactgtggtcgaatggtgtcctcgaaagcgatatgatcattccaaaatccctggcaggcccgatctcacagcacaaccataggcccgggtatcacactcaaaccgcgggaccttggcaccttggcaagttggagctggactttaattactgcgaggggacaacggtggtgattaccgaaaactgtggaactcgtggcccaagtttacggacaaccactgtctctggtaaactcatccatgagtggtgctgtcgaagctgcacactgccccctcttagatatatgggggaagatggatgttggtacggcatggagataaggccaatttccgaaaaggaggagaatatggttaaatcactggtgagcgcctga

SEQ ID NO: 1870 - RNA, 1824 nt, synthetic construct
  misc_feature 1..1824: note = derived and/or modified CDS sequence (opt3) from DENV-3 Consensus__SSm-EdelTM-linker-ferritin
  source 1..1824: mol_type = other RNA
atgacccagaaggtggtcatcttcattctgctcatgcttgttacacccagcatgactatgagatgcgtgggcgtagggaacagggactttgtggagggactgtccggtgccacgtgggtcgatgtggttttggaacacggcgggtgtgtgaccacaatggctaaaaataagcctactttagacatagagctgcagaaaaccgaagcaacacagctagccaccctccggaagctgtgcatcgagggaaaaattactaacatcacaaccgattctcgctgtccaacgcagggcgaagcgactcttccggaggagcaggaccaaaattacgtctgcaagcatacctatgtggatcgaggttgggggaacggatgtggcctgttcggcaaggggtcattggtaacatgcgctaaatttcagtgtctcgaacccattgagggaaaggttgtgcagtacgaaaatctgaaatatactgtcatcataaccgtgcacacaggtgaccagcatcaagtgggcaacgagacccagggggtcacggccgagatcactcctcaggcaagtacaaccgaagccattctgccagagtacggaactctcggcttagaatgcagcccccgtacaggtctggatttcaatgagatgatccttttgaccatgaagaacaaggcttggatggttcacagacagtggtttttcgacctgcctctaccatggacgtccggggcaaccacagaaactcccacctggaataggaaagagctcctggtgacatttaagaacgcccatgctaaaaagcaagaggtagtggtccttggatctcaggaaggcgccatgcacactgcgctgaccggcgcaacagagattcaaaattcagggggaacctcgatcttcgccggtcacttgaaatgtcggctcaagatggataaactggaattaaagggcatgagctatgctatgtgcactaacacgtttgtgctgaaaaaggaggttagtgaaacacaacatgggaccatactcattaaggtggagtacaaaggagaggacgtcccttgtaagatcccattctccactgaagatggccagggtaaagcccacaatgggcgccttattaccgcaaacccggtggtaacaaagaaagaggaacccgttaatatcgaggctgaacctccatttggcgagtctaacatcgtgattggaataggcgacaacgccctgaagatcaattggtataagaaagggagctccattggaaagatgttcgaggcgaccgccagaggtgcaaggcggatggctatcttgggcgatactgcctgggactttgggtcaagtggaggcgacataattaaactactgaacgaacaggtcaataaggagatgcagagctctaacctctacatgtccatgtcaagctggtgctacacacatagtctggatggtgctgggcttttcctgttcgaccacgccgcagaagagtatgagcacgccaaaaagttgatcatctttctcaatgaaaacaatgtgcccgtccaactgacgtctatttccgctcctgagcataagttcgaaggcttaacccagatctttcagaaagcgtacgagcacgaacagcatattagcgagtcgataaacaatatcgtggatcacgcaattaagtctaaagaccatgccactttcaactttctgcaatggtatgttgctgagcagcacgaagaggaagtgctattcaaggatatcctcgacaaaatcgagctgattggaaatgaaaaccacggcctttacttggccgatcagtatgtaaaggggatagcaaagtcccgcaaatcatga

SEQ ID NO: 1871 - RNA, 1821 nt, synthetic construct
  misc_feature 1..1821: note = derived and/or modified CDS sequence (opt3) from DENV-3 Consensus__SStPA-WHbcAg-linker-EdelTM
  source 1..1821: mol_type = other RNA
atggacgccatgaagagaggcctgtgctgtgtgctccttctgtgcggggctgtcttcgttgatagcgtgaccggaatggacatcgatccctacaaagagtttggttcctcttatcagttgttaaacttcctgcctctagactttttcccagatctcaatgcactggtagacacagccactgcgctttacgaagaggaactgacgggcagggagcactgttcaccgcatcacaccgctattcggcaagccttggtgtgctgggatgaactcacaaagctgatagcatggatgagtagcaacatcacttccgagcaggtccgcaccattatcgtgaatcatgttaacgacacatgggggctgaaagtgcgacagtctctctggtttcacttatcgtgtctgaccttcggacagcatactgtccaagagtttcttgtgtcattcggcgtatggattcgtacacccgccccttatagaccacccaatgctcctatcttgagcaccctgccagaacacacggttatatgcggtgggggaggcagtggcgggggaggtatgaggtgtgtgggcgtcgggaaccgggattttgtggagggactatccggcgcaacttgggtggacgtcgttctcgaacacggtgggtgcgtgaccacaatggccaagaataaacccactctggatatcgagcttcagaagaccgaggctacacagctggccaccttgcgcaagctctgtattgaaggaaaaatcacgaacattactacagactctagatgccctacccagggcgaggcgactctgccagaggaacaagatcagaattacgtatgtaagcatacatatgtggacaggggctgggggaacggatgcggtttattcggcaaagggagcctggtgacctgcgcaaagtttcagtgtctcgaaccgatcgagggaaaagtcgttcagtacgagaatcttaagtatacggtgataattaccgtccacacaggcgaccaacatcaggtgggtaacgaaactcagggggtaaccgccgagatcacaccccaggcttccactaccgaagccattctgcctgagtacggcacattgggactagaatgctcaccacggaccggcctggatttcaatgagatgatcctcctgactatgaagaacaaagcatggatggttcaccgccaatggtttttcgaccttcccctgccttggacgagtggggctacaaccgagactccaacctggaatcgaaaggaattgctcgtgacattcaaaaacgcccacgcgaagaaacaggaggtcgtggtcctgggaagccaggaaggtgccatgcataccgcattaactggcgctacagagatccaaaactctgggggaacgtccatttttgccggccacctgaagtgtagactaaaaatggataagctcgaactgaagggtatgtcatacgctatgtgcaccaatactttcgtgcttaaaaaggaggttagcgagacacagcatgggaccatattgatcaaagtggaatataagggcgaggacgtaccctgtaaaattccgtttagtacagaagatggacagggcaaggcccacaacgggaggctgatcactgcaaatcctgtcgtgaccaagaaagaggagcccgttaacatagaagccgagccacctttcggagaatctaatattgtgatcggtatcggcgacaacgctctcaagattaattggtacaaaaaggggtccagcatcggaaaaatgtttgaggcgacggcacggggcgcccgtcgcatggctattctgggtgataccgcctgggacttcgggtcgtga

SEQ ID NO: 1872 - RNA, 75 nt, synthetic construct
  misc_feature 1..75: note = derived and/or modified CDS sequence (opt4) from Homo sapiens__SigSeq(TPA)/SStPA
  source 1..75: mol_type = other RNA
atggacgccatgaagagaggcctgtgctgcgtgctgctgctgtgcggcgccgtgttcgtggacagcgtgaccggc

SEQ ID NO: 1873 - RNA, 489 nt, synthetic construct
  misc_feature 1..489: note = derived and/or modified CDS sequence (opt4) from Helicobacter pylori J99__Ferritin
  source 1..489: mol_type = other RNA
gacatcatcaagctgctgaacgagcaggtgaacaaggagatgcagagcagcaacctgtacatgagcatgagcagctggtgctacacccacagcctggacggcgccggcctgttcctgttcgaccacgccgccgaggagtacgagcacgccaagaagctgatcatcttcctgaacgagaacaacgtgcccgtgcagctgaccagcatcagcgcccccgagcacaagttcgagggcctgacccagatcttccagaaggcctacgagcacgagcagcacatcagcgagagcatcaacaacatcgtggaccacgccatcaagagcaaggaccacgccaccttcaacttcctgcagtggtacgtggccgagcagcacgaggaggaggtgctgttcaaggacatcctggacaagatcgagctgatcggcaacgagaaccacggcctgtacctggccgaccagtacgtgaagggcatcgccaagagcagaaagagc

SEQ ID NO: 1874 - RNA, 450 nt, synthetic construct
  misc_feature 1..450: note = derived and/or modified CDS sequence (opt4) from Woodchuck hepatitis virus__WHbcAg
  source 1..450: mol_type = other RNA
atggacatcgacccctacaaggagttcggcagcagctaccagctgctgaacttcctgcccctggacttcttccccgacctgaacgccctggtggacaccgccaccgccctgtacgaggaggagctgaccggcagagagcactgcagcccccaccacaccgccatcagacaggccctggtgtgctgggacgagctgaccaagctgatcgcctggatgagcagcaacatcaccagcgagcaggtgagaaccatcatcgtgaaccacgtgaacgacacctggggcctgaaggtgagacagagcctgtggttccacctgagctgcctgaccttcggccagcacaccgtgcaggagttcctggtgagcttcggcgtgtggatcagaacccccgccccctacagaccccccaacgcccccatcctgagcaccctgcccgagcacaccgtgatctgc

SEQ ID NO: 1875 - RNA, 303 nt, synthetic construct
  misc_feature 1..303: note = derived and/or modified CDS sequence (opt4) from Japanese encephalitis virus__Cterm-JEV/JEV
  source 1..303: mol_type = other RNA
ggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcc

SEQ ID NO: 1876 - RNA, 15 nt, synthetic construct
  misc_feature 1..15: note = derived and/or modified CDS sequence (opt4) from Artificial__MKRKK
  source 1..15: mol_type = other RNA
atgaagagaaagaag

SEQ ID NO: 1877 - skipped

SEQ ID NO: 1878 - RNA, 27 nt, synthetic construct
  misc_feature 1..27: note = derived and/or modified CDS sequence (opt4) from Artificial__Linker(G4SG4)
  source 1..27: mol_type = other RNA
ggcggcggcggcagcggcggcggcggc

SEQ ID NO: 1879 - RNA, 51 nt, synthetic construct
  misc_feature 1..51: note = derived and/or modified CDS sequence (opt4) from Foot-and-mouth disease virus__F2A/P2A
  source 1..51: mol_type = other RNA
aacttcgacctgctgaagctggccggcgacgtggagagcaaccccggcccc

SEQ ID NO: 1880 - RNA, 300 nt, synthetic construct
  misc_feature 1..300: note = derived and/or modified CDS sequence (opt4) from DENV-1 CYD23__C
  source 1..300: mol_type = other RNA
atgaacaaccagagaaagaagaccgccagacccagcttcaacatgctgaagagagccagaaacagagtgagcaccgtgagccagctggccaagagattcagcaagggcctgctgagcggccagggccccatgaagctggtgatggccttcatcgccttcctgagattcctggccatcccccccaccgccggcatcctggccagatggggcagcttcaagaagaacggcgccatcaaggtgctgagaggcttcaagaaggagatcagcaacatgctgaacatcatgaacagaagaagaaag

SEQ ID NO: 1881 - RNA, 342 nt, synthetic construct
  misc_feature 1..342: note = derived and/or modified CDS sequence (opt4) from DENV-1 CYD23__C-SSc
  source 1..342: mol_type = other RNA
atgaacaaccagagaaagaagaccgccagacccagcttcaacatgctgaagagagccagaaacagagtgagcaccgtgagccagctggccaagagattcagcaagggcctgctgagcggccagggccccatgaagctggtgatggccttcatcgccttcctgagattcctggccatcccccccaccgccggcatcctggccagatggggcagcttcaagaagaacggcgccatcaaggtgctgagaggcttcaagaaggagatcagcaacatgctgaacatcatgaacagaagaagaaagagcgtgaccatgctgctgatgctgatgcccaccgccctggcc

SEQ ID NO: 1882 - RNA, 273 nt, synthetic construct
  misc_feature 1..273: note = derived and/or modified CDS sequence (opt4) from DENV-1 CYD23__pr
  source 1..273: mol_type = other RNA
ttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagaga

SEQ ID NO: 1883 - RNA, 225 nt, synthetic construct
  misc_feature 1..225: note = derived and/or modified CDS sequence (opt4) from DENV-1 CYD23__M
  source 1..225: mol_type = other RNA
agcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggcc

SEQ ID NO: 1884 - RNA, 498 nt, synthetic construct
  misc_feature 1..498: note = derived and/or modified CDS sequence (opt4) from DENV-1 CYD23__prM
  source 1..498: mol_type = other RNA
ttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggcc

SEQ ID NO: 1885 - RNA, 1485 nt, synthetic construct
  misc_feature 1..1485: note = derived and/or modified CDS sequence (opt4) from DENV-1 CYD23__E
  source 1..1485: mol_type = other RNA
atgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcc

SEQ ID NO: 1886 - RNA, 1983 nt, synthetic construct
  misc_feature 1..1983: note = derived and/or modified CDS sequence (opt4) from DENV-1 CYD23__prME
  source 1..1983: mol_type = other RNA
ttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcc

SEQ ID NO: 1887 - RNA, 2025 nt, synthetic construct
  misc_feature 1..2025: note = derived and/or modified CDS sequence (opt4) from DENV-1 CYD23__SSc-prME
  source 1..2025: mol_type = other RNA
agcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcc

SEQ ID NO: 1888 - RNA, 2325 nt, synthetic construct
  misc_feature 1..2325: note = derived and/or modified CDS sequence (opt4) from DENV-1 CYD23__C-prME
  source 1..2325: mol_type = other RNA
atgaacaaccagagaaagaagaccgccagacccagcttcaacatgctgaagagagccagaaacagagtgagcaccgtgagccagctggccaagagattcagcaagggcctgctgagcggccagggccccatgaagctggtgatggccttcatcgccttcctgagattcctggccatcccccccaccgccggcatcctggccagatggggcagcttcaagaagaacggcgccatcaaggtgctgagaggcttcaagaaggagatcagcaacatgctgaacatcatgaacagaagaagaaagagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcc

SEQ ID NO: 1889 - RNA, 45 nt, synthetic construct
  misc_feature 1..45: note = derived and/or modified CDS sequence (opt4) from DENV-1 CYD23__SSc
  source 1..45: mol_type = other RNA
atgagcgtgaccatgctgctgatgctgatgcccaccgccctggcc

SEQ ID NO: 1890 - RNA, 57 nt, synthetic construct
  misc_feature 1..57: note = derived and/or modified CDS sequence (opt4) from DENV-1 CYD23__SSopt
  source 1..57: mol_type = other RNA
atgaagagaaagaagagcgtgaccatgctgctgatgctgatgcccaccgccctggcc

SEQ ID NO: 1891 - RNA, 57 nt, synthetic construct
  misc_feature 1..57: note = derived and/or modified CDS sequence (opt4) from DENV-1 CYD23__SSm
  source 1..57: mol_type = other RNA
atgacccagaagggcatcatcttcatcctgctgatgctggtgacccccagcatggcc

SEQ ID NO: 1892 - RNA, 1488 nt, synthetic construct
  misc_feature 1..1488: note = derived and/or modified CDS sequence (opt4) from DENV-1 CYD23__E
  source 1..1488: mol_type = other RNA
atgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcctga

SEQ ID NO: 1893 - RNA, 1182 nt, synthetic construct
  misc_feature 1..1182: note = derived and/or modified CDS sequence (opt4) from DENV-1 CYD23__EdelTM-variant (aa1-394)
  source 1..1182: mol_type = other RNA
atgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaag

SEQ ID NO: 1894 - RNA, 1275 nt, synthetic construct
  misc_feature 1..1275: note = derived and/or modified CDS sequence (opt4) from DENV-1 CYD23__EdelTM-variant (aa1-424)
  source 1..1275: mol_type = other RNA
atgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagctga

SEQ ID NO: 1895 - RNA, 1266 nt, synthetic construct
  misc_feature 1..1266: note = derived and/or modified CDS sequence (opt4) from DENV-1 CYD23__EdelTM-variant (aa1-421)
  source 1..1266: mol_type = other RNA
atgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggactga

SEQ ID NO: 1896 - RNA, 2031 nt, synthetic construct
  misc_feature 1..2031: note = derived and/or modified CDS sequence (opt4) from DENV-1 CYD23__SSc-prME
  source 1..2031: mol_type = other RNA
atgagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcctga

SEQ ID NO: 1897 - RNA, 2031 nt, synthetic construct
  misc_feature 1..2031: note = derived and/or modified CDS sequence (opt4) from DENV-1 CYD23__SSc-prME(F108S)
  source 1..2031: mol_type = other RNA
atgagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgagcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcctga

SEQ ID NO: 1898 - RNA, 2031 nt, synthetic construct
  misc_feature 1..2031: note = derived and/or modified CDS sequence (opt4) from DENV-1 CYD23__SSc-prMEdelstem_TM-JEV
  source 1..2031: mol_type = other RNA
atgagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1899 - RNA, 2379 nt, synthetic construct
  misc_feature 1..2379: note = derived and/or modified CDS sequence (opt4) from DENV-1 CYD23__C-P2A-SSc-prME
  source 1..2379: mol_type = other RNA
atgaacaaccagagaaagaagaccgccagacccagcttcaacatgctgaagagagccagaaacagagtgagcaccgtgagccagctggccaagagattcagcaagggcctgctgagcggccagggccccatgaagctggtgatggccttcatcgccttcctgagattcctggccatcccccccaccgccggcatcctggccagatggggcagcttcaagaagaacggcgccatcaaggtgctgagaggcttcaagaaggagatcagcaacatgctgaacatcatgaacagaagaagaaagaacttcgacctgctgaagctggccggcgacgtggagagcaaccccggccccagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgctgacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcctga

SEQ ID NO: 1900 - RNA, 2043 nt, synthetic construct
  misc_feature 1..2043: note = derived and/or modified CDS sequence (opt4) from DENV-1 CYD23__SSopt-prME(F108S)
  source 1..2043: mol_type = other RNA
atgaagagaaagaagagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgagcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcctga

SEQ ID NO: 1901 - RNA, 2043 nt, synthetic construct
  misc_feature 1..2043: note = derived and/or modified CDS sequence (opt4) from DENV-1 CYD23__SSopt-prME(F96H)
  source 1..2043: mol_type = other RNA
atgaagagaaagaagagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaacccacgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcctga

SEQ ID NO: 1902 - RNA, 2043 nt, synthetic construct
  misc_feature 1..2043: note = derived and/or modified CDS sequence (opt4) from DENV-1 CYD23__SSopt-prME(S186F)
  source 1..2043: mol_type = other RNA
atgaagagaaagaagagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcttccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcctga

SEQ ID NO: 1903 - RNA, 2043 nt, synthetic construct
  misc_feature 1..2043: note = derived and/or modified CDS sequence (opt4) from DENV-1 CYD23__SSopt-prME(R188L)
  source 1..2043: mol_type = other RNA
atgaagagaaagaagagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccctgaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagcatcggcggcgtgttcaccagcgtgggcaagctggtgcaccagatcttcggcaccgcctacggcgtgctgttcagcggcgtgagctggaccatgaagatcggcatcggcgtgctgctgacctggctgggcctgaacagcagaagcaccagcctgagcatgacctgcatcgccgtgggcctggtgaccctgtacctgggcgtgatggtgcaggcctga

SEQ ID NO: 1904 - RNA, 2043 nt, synthetic construct
  misc_feature 1..2043: note = derived and/or modified CDS sequence (opt4) from DENV-1 CYD23__SSopt-pr(D104A)MEdelstem_TM,(F108S)-JEV
  source 1..2043: mol_type = other RNA
atgaagagaaagaagagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagccaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgagcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1905 - RNA, 2043 nt, synthetic construct
  misc_feature 1..2043: note = derived and/or modified CDS sequence (opt4) from DENV-1 CYD23__SSopt-prMEdelstem_TM,(H261N)-JEV
  source 1..2043: mol_type = other RNA
atgaagagaaagaagagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgaacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1906 - RNA, 2043 nt, synthetic construct
  misc_feature 1..2043: note = derived and/or modified CDS sequence (opt4) from DENV-1 CYD23__SSopt-prMEdelstem_TM,(R188L,A267T)-JEV
  source 1..2043: mol_type = other RNA
atgaagagaaagaagagcgtgaccatgctgctgatgctgatgcccaccgccctggccttccacctgaccaccagaggcggcgagccccacatgatcgtgagcaagcaggagagaggcaagagcctgctgttcaagaccagcgccggcgtgaacatgtgcaccctgatcgccatggacctgggcgagctgtgcgaggacaccatgacctacaagtgccccagaatcaccgaggccgagcccgacgacgtggactgctggtgcaacgccaccgacacctgggtgacctacggcacctgcagccagaccggcgagcacagaagagacaagagaagcgtggccctggccccccacgtgggcctgggcctggagaccagaaccgagacctggatgagcagcgagggcgcctggaagcagatccagagagtggagacctgggccctgagacaccccggcttcaccgtgatcgccctgttcctggcccacgccatcggcaccagcatcacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccctgaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcaccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1907 - RNA, 300 nt, synthetic construct
  misc_feature 1..300: note = derived and/or modified CDS sequence (opt4) from DENV-2 CYD2-T__C
  source 1..300: mol_type = other RNA
atgaacaaccagagaaagaaggccaagaacacccccttcaacatgctgaagagagagagaaacagagtgagcaccgtgcagcagctgaccaagagattcagcctgggcatgctgcagggcagaggccccctgaagctgttcatggccctggtggccttcctgagattcctgaccatcccccccaccgccggcatcctgaagagatggggcaccatcaagaagagcaaggccatcaacgtgctgagaggcttcagaaaggagatcggcagaatgctgaacatcctgaacagaagaagaaga

SEQ ID NO: 1908 - RNA, 342 nt, synthetic construct
  misc_feature 1..342: note = derived and/or modified CDS sequence (opt4) from DENV-2 CYD2-T__C-SSc
  source 1..342: mol_type = other RNA
atgaacaaccagagaaagaaggccaagaacacccccttcaacatgctgaagagagagagaaacagagtgagcaccgtgcagcagctgaccaagagattcagcctgggcatgctgcagggcagaggccccctgaagctgttcatggccctggtggccttcctgagattcctgaccatcccccccaccgccggcatcctgaagagatggggcaccatcaagaagagcaaggccatcaacgtgctgagaggcttcagaaaggagatcggcagaatgctgaacatcctgaacagaagaagaagaagcgccggcatgatcatcatgctgatccccaccgtgatggcc

SEQ ID NO: 1909 - RNA, 273 nt, synthetic construct
  misc_feature 1..273: note = derived and/or modified CDS sequence (opt4) from DENV-2 CYD2-T__pr
  source 1..273: mol_type = other RNA
ttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagaga

SEQ ID NO: 1910 - RNA, 225 nt, synthetic construct
  misc_feature 1..225: note = derived and/or modified CDS sequence (opt4) from DENV-2 CYD2-T__M
  source 1..225: mol_type = other RNA
agcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgacc

SEQ ID NO: 1911 - RNA, 498 nt, synthetic construct
  misc_feature 1..498: note = derived and/or modified CDS sequence (opt4) from DENV-2 CYD2-T__prM
  source 1..498: mol_type = other RNA
ttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgacc

SEQ ID NO: 1912 - RNA, 1485 nt, synthetic construct
  misc_feature 1..1485: note = derived and/or modified CDS sequence (opt4) from DENV-2 CYD2-T__E
  source 1..1485: mol_type = other RNA
atgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcc

SEQ ID NO: 1913 - RNA, 1983 nt, synthetic construct
  misc_feature 1..1983: note = derived and/or modified CDS sequence (opt4) from DENV-2 CYD2-T__prME
  source 1..1983: mol_type = other RNA
ttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcc

SEQ ID NO: 1914 - RNA, 2025 nt, synthetic construct
  misc_feature 1..2025: note = derived and/or modified CDS sequence (opt4) from DENV-2 CYD2-T__SSc-prME
  source 1..2025: mol_type = other RNA
agcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcc

SEQ ID NO: 1915 - RNA, 2325 nt, synthetic construct
  misc_feature 1..2325: note = derived and/or modified CDS sequence (opt4) from DENV-2 CYD2-T__C-prME
  source 1..2325: mol_type = other RNA
atgaacaaccagagaaagaaggccaagaacacccccttcaacatgctgaagagagagagaaacagagtgagcaccgtgcagcagctgaccaagagattcagcctgggcatgctgcagggcagaggccccctgaagctgttcatggccctggtggccttcctgagattcctgaccatcccccccaccgccggcatcctgaagagatggggcaccatcaagaagagcaaggccatcaacgtgctgagaggcttcagaaaggagatcggcagaatgctgaacatcctgaacagaagaagaagaagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcc

SEQ ID NO: 1916 - RNA, 45 nt, synthetic construct; identical to SEQ ID NO: 1304
  misc_feature 1..45: note = derived and/or modified CDS sequence (opt4) from DENV-2 CYD2-T__SSc
  source 1..45: mol_type = other RNA

SEQ ID NO: 1917 - RNA, 57 nt, synthetic construct
  misc_feature 1..57: note = derived and/or modified CDS sequence (opt4) from DENV-2 CYD2-T__SSopt
  source 1..57: mol_type = other RNA
atgaagagaaagaagagcgccggcatgatcatcatgctgatccccaccgtgatggcc

SEQ ID NO: 1918 - RNA, 57 nt, synthetic construct
  misc_feature 1..57: note = derived and/or modified CDS sequence (opt4) from DENV-2 CYD2-T__SSm
  source 1..57: mol_type = other RNA
atgttccagagagccctgatcttcatcctgctgaccgccgtgacccccagcatgacc

SEQ ID NO: 1919 - RNA, 1488 nt, synthetic construct
  misc_feature 1..1488: note = derived and/or modified CDS sequence (opt4) from DENV-2 CYD2-T__E
  source 1..1488: mol_type = other RNA
atgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcctga

SEQ ID NO: 1920 - RNA, 1182 nt, synthetic construct
  misc_feature 1..1182: note = derived and/or modified CDS sequence (opt4) from DENV-2 CYD2-T__EdelTM-variant (aa1-394)
  source 1..1182: mol_type = other RNA
atgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaag

SEQ ID NO: 1921 - RNA, 1272 nt, synthetic construct
  misc_feature 1..1272: note = derived and/or modified CDS sequence (opt4) from DENV-2 CYD2-T__EdelTM-variant (aa1-424)
  source 1..1272: mol_type = other RNA
atgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagc

SEQ ID NO: 1922 - RNA, 1263 nt, synthetic construct
  misc_feature 1..1263: note = derived and/or modified CDS sequence (opt4) from DENV-2 CYD2-T__EdelTM-variant (aa1-421)
  source 1..1263: mol_type = other RNA
atgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggac

SEQ ID NO: 1923 - RNA, 2031 nt, synthetic construct
  misc_feature 1..2031: note = derived and/or modified CDS sequence (opt4) from DENV-2 CYD2-T__SSc-prME
  source 1..2031: mol_type = other RNA
atgagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcctga

SEQ ID NO: 1924 - RNA, 2031 nt, synthetic construct
  misc_feature 1..2031: note = derived and/or modified CDS sequence (opt4) from DENV-2 CYD2-T__SSc-prME(F108S)
  source 1..2031: mol_type = other RNA
atgagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgagcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcctga

SEQ ID NO: 1925 - RNA, 2031 nt, synthetic construct
  misc_feature 1..2031: note = derived and/or modified CDS sequence (opt4) from DENV-2 CYD2-T__SSc-prMEdelstem_TM-JEV
  source 1..2031: mol_type = other RNA
atgagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1926 - RNA, 1332 nt, synthetic construct
  misc_feature 1..1332: note = derived and/or modified CDS sequence (opt4) from DENV-2 CYD2-T__SSm-EdelTM
  source 1..1332: mol_type = other RNA
atgttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagctga

SEQ ID NO: 1927 - RNA, 2379 nt, synthetic construct
  misc_feature 1..2379: note = derived and/or modified CDS sequence (opt4) from DENV-2 CYD2-T__C-P2A-SSc-prME
  source 1..2379: mol_type = other RNA
atgaacaaccagagaaagaaggccaagaacacccccttcaacatgctgaagagagagagaaacagagtgagcaccgtgcagcagctgaccaagagattcagcctgggcatgctgcagggcagaggccccctgaagctgttcatggccctggtggccttcctgagattcctgaccatcccccccaccgccggcatcctgaagagatggggcaccatcaagaagagcaaggccatcaacgtgctgagaggcttcagaaaggagatcggcagaatgctgaacatcctgaacagaagaagaagaaacttcgacctgctgaagctggccggcgacgtggagagcaaccccggccccagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcctga

SEQ ID NO: 1928 - RNA, 2043 nt, synthetic construct
  misc_feature 1..2043: note = derived and/or modified CDS sequence (opt4) from DENV-2 CYD2-T__SSopt-prME(F108S)
  source 1..2043: mol_type = other RNA
atgaagagaaagaagagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgagcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcctga

SEQ ID NO: 1929 - RNA, 2043 nt, synthetic construct
  misc_feature 1..2043: note = derived and/or modified CDS sequence (opt4) from DENV-2 CYD2-T__SSopt-prME(M96H)
  source 1..2043: mol_type = other RNA
atgaagagaaagaagagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagccacgtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcctga

SEQ ID NO: 1930 - RNA, 2043 nt, synthetic construct
  misc_feature 1..2043: note = derived and/or modified CDS sequence (opt4) from DENV-2 CYD2-T__SSopt-prME(S186F)
  source 1..2043: mol_type = other RNA
atgaagagaaagaagagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcttccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcctga

SEQ ID NO: 1931 - RNA, 2043 nt, synthetic construct
  misc_feature 1..2043: note = derived and/or modified CDS sequence (opt4) from DENV-2 CYD2-T__SSopt-prME(R188L)
  source 1..2043: mol_type = other RNA
atgaagagaaagaagagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccctgaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcagcatcggccagatgttcgagaccaccatgagaggcgccaagagaatggccatcctgggcgacaccgcctgggacttcggcagcctgggcggcgtgttcaccagcatcggcaaggccctgcaccaggtgttcggcgccatctacggcgccgccttcagcggcgtgagctggaccatgaagatcctgatcggcgtgatcatcacctggatcggcatgaacagcagaagcaccagcctgagcgtgaccctggtgctggtgggcatcgtgaccctgtacctgggcgtgatggtgcaggcctga

SEQ ID NO: 1932 - RNA, 2043 nt, synthetic construct
  misc_feature 1..2043: note = derived and/or modified CDS sequence (opt4) from DENV-2 CYD2-T__SSopt-pr(D104A)MEdelstem_TM,(F108S)-JEV
  source 1..2043: mol_type = other RNA
atgaagagaaagaagagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagccaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgagcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1933 - RNA, 2043 nt, synthetic construct
  misc_feature 1..2043: note = derived and/or modified CDS sequence (opt4) from DENV-2 CYD2-T__SSopt-prMEdelstem_TM,(H261N)-JEV
  source 1..2043: mol_type = other RNA
atgaagagaaagaagagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccagaaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgaacaccgccctgaccggcgccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1934 - RNA, 2043 nt, synthetic construct
  misc_feature 1..2043: note = derived and/or modified CDS sequence (opt4) from DENV-2 CYD2-T__SSopt-prMEdelstem_TM,(R188L,A267T)-JEV
  source 1..2043: mol_type = other RNA
atgaagagaaagaagagcgccggcatgatcatcatgctgatccccaccgtgatggccttccacctgaccaccagaaacggcgagccccacatgatcgtgagcagacaggagaagggcaagagcctgctgttcaagaccgaggacggcgtgaacatgtgcaccctgatggccatggacctgggcgagctgtgcgaggacaccatcacctacaagtgccccctgctgagacagaacgagcccgaggacatcgactgctggtgcaacagcaccagcacctgggtgacctacggcacctgcaccaccatgggcgagcacagaagagagaagagaagcgtggccctggtgccccacgtgggcatgggcctggagaccagaaccgagacctggatgagcagcgagggcgcctggaagcacgtgcagagaatcgagacctggatcctgagacaccccggcttcaccatgatggccgccatcctggcctacaccatcggcaccacccacttccagagagccctgatcttcatcctgctgaccgccgtgacccccagcatgaccatgagatgcatcggcatgagcaacagagacttcgtggagggcgtgagcggcggcagctgggtggacatcgtgctggagcacggcagctgcgtgaccaccatggccaagaacaagcccaccctggacttcgagctgatcaagaccgaggccaagcagcccgccaccctgagaaagtactgcatcgaggccaagctgaccaacaccaccaccgagagcagatgccccacccagggcgagcccagcctgaacgaggagcaggacaagagattcgtgtgcaagcacagcatggtggacagaggctggggcaacggctgcggcctgttcggcaagggcggcatcgtgacctgcgccatgttcagatgcaagaagaacatggagggcaaggtggtgcagcccgagaacctggagtacaccatcgtgatcaccccccacagcggcgaggagcacgccgtgggcaacgacaccggcaagcacggcaaggagatcaagatcaccccccagagcagcatcaccgaggccgagctgaccggctacggcaccgtgaccatggagtgcagccccctgaccggcctggacttcaacgagatggtgctgctgcagatggagaacaaggcctggctggtgcacagacagtggttcctggacctgcccctgccctggctgcccggcgccgacacccagggcagcaactggatccagaaggagaccctggtgaccttcaagaacccccacgccaagaagcaggacgtggtggtgctgggcagccaggagggcgccatgcacaccgccctgaccggcaccaccgagatccagatgagcagcggcaacctgctgttcaccggccacctgaagtgcagactgagaatggacaagctgcagctgaagggcatgagctacagcatgtgcaccggcaagttcaaggtggtgaaggagatcgccgagacccagcacggcaccatcgtgatcagagtgcagtacgagggcgacggcagcccctgcaagatccccttcgagatcatggacctggagaagagacacgtgctgggcagactgatcaccgtgaaccccatcgtgaccgagaaggacagccccgtgaacatcgaggccgagccccccttcggcgacagctacatcatcatcggcgtggagcccggccagctgaagctgaactggttcaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1935 - RNA, 297 nt, synthetic construct
  misc_feature 1..297: note = derived and/or modified CDS sequence (opt4) from DENV-4 Consensus__C
  source 1..297: mol_type = other RNA
atgaaccagagaaagaaggtggtgagaccccccttcaacatgctgaagagagagagaaacagagtgagcaccccccagggcctggtgaagagattcagcaccggcctgttcagcggcaagggccccctgagaatggtgctggccttcatcaccttcctgagagtgctgagcatcccccccaccgccggcatcctgaagagatggggccagctgaagaagaacaaggccatcaagatcctgatcggcttcagaaaggagatcggcagaatgctgaacatcctgaacggcagaaagaga

SEQ ID NO: 1936 - RNA, 339 nt, synthetic construct
  misc_feature 1..339: note = derived and/or modified CDS sequence (opt4) from DENV-4 Consensus__C-SSc
  source 1..339: mol_type = other RNA
atgaaccagagaaagaaggtggtgagaccccccttcaacatgctgaagagagagagaaacagagtgagcaccccccagggcctggtgaagagattcagcaccggcctgttcagcggcaagggccccctgagaatggtgctggccttcatcaccttcctgagagtgctgagcatcccccccaccgccggcatcctgaagagatggggccagctgaagaagaacaaggccatcaagatcctgatcggcttcagaaaggagatcggcagaatgctgaacatcctgaacggcagaaagagaagcaccatcaccctgctgtgcctgatccccaccgtgatggcc

SEQ ID NO: 1937 - RNA, 273 nt, synthetic construct
  misc_feature 1..273: note = derived and/or modified CDS sequence (opt4) from DENV-4 Consensus__pr
  source 1..273: mol_type = other RNA
ttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagaga

SEQ ID NO: 1938 - RNA, 225 nt, synthetic construct
  misc_feature 1..225: note = derived and/or modified CDS sequence (opt4) from DENV-4 Consensus__M
  source 1..225: mol_type = other RNA
agcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggc

SEQ ID NO: 1939 - RNA, 498 nt, synthetic construct
  misc_feature 1..498: note = derived and/or modified CDS sequence (opt4) from DENV-4 Consensus__prM
  source 1..498: mol_type = other RNA
ttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggc

SEQ ID NO: 1940 - RNA, 1485 nt, synthetic construct
  misc_feature 1..1485: note = derived and/or modified CDS sequence (opt4) from DENV-4 Consensus__E
  source 1..1485: mol_type = other RNA
atgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcc

SEQ ID NO: 1941 - RNA, 1983 nt, synthetic construct
  misc_feature 1..1983: note = derived and/or modified CDS sequence (opt4) from DENV-4 Consensus__prME
  source 1..1983: mol_type = other RNA
ttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcc

SEQ ID NO: 1942 - RNA, 2025 nt, synthetic construct
  misc_feature 1..2025: note = derived and/or modified CDS sequence (opt4) from DENV-4 Consensus__SSc-prME
  source 1..2025: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcc

SEQ ID NO: 1943 - RNA, 2322 nt, synthetic construct
  misc_feature 1..2322: note = derived and/or modified CDS sequence (opt4) from DENV-4 Consensus__C-prME
  source 1..2322: mol_type = other RNA
atgaaccagagaaagaaggtggtgagaccccccttcaacatgctgaagagagagagaaacagagtgagcaccccccagggcctggtgaagagattcagcaccggcctgttcagcggcaagggccccctgagaatggtgctggccttcatcaccttcctgagagtgctgagcatcccccccaccgccggcatcctgaagagatggggccagctgaagaagaacaaggccatcaagatcctgatcggcttcagaaaggagatcggcagaatgctgaacatcctgaacggcagaaagagaagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcc

SEQ ID NO: 1944 - RNA, 45 nt, synthetic construct
  misc_feature 1..45: note = derived and/or modified CDS sequence (opt4) from DENV-4 Consensus__SSc
  source 1..45: mol_type = other RNA
atgagcaccatcaccctgctgtgcctgatccccaccgtgatggcc

SEQ ID NO: 1945 - RNA, 57 nt, synthetic construct
  misc_feature 1..57: note = derived and/or modified CDS sequence (opt4) from DENV-4 Consensus__SSopt
  source 1..57: mol_type = other RNA
atgaagagaaagaagagcaccatcaccctgctgtgcctgatccccaccgtgatggcc

SEQ ID NO: 1946 - RNA, 57 nt, synthetic construct
  misc_feature 1..57: note = derived and/or modified CDS sequence (opt4) from DENV-4 Consensus__SSm
  source 1..57: mol_type = other RNA
atgatccagagaaccgtgttcttcgtgctgatgatgctggtggcccccagctacggc

SEQ ID NO: 1947 - RNA, 1488 nt, synthetic construct
  misc_feature 1..1488: note = derived and/or modified CDS sequence (opt4) from DENV-4 Consensus__E
  source 1..1488: mol_type = other RNA
atgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcctga

SEQ ID NO: 1948 - RNA, 1182 nt, synthetic construct
  misc_feature 1..1182: note = derived and/or modified CDS sequence (opt4) from DENV-4 Consensus__EdelTM-variant (aa1-394)
  source 1..1182: mol_type = other RNA
atgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaag

SEQ ID NO: 1949 - RNA, 1272 nt, synthetic construct
  misc_feature 1..1272: note = derived and/or modified CDS sequence (opt4) from DENV-4 Consensus__EdelTM-variant (aa1-424)
  source 1..1272: mol_type = other RNA
atgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagc

SEQ ID NO: 1950 - RNA, 1266 nt, synthetic construct
  misc_feature 1..1266: note = derived and/or modified CDS sequence (opt4) from DENV-4 Consensus__EdelTM-variant (aa1-421)
  source 1..1266: mol_type = other RNA
atgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggactga

SEQ ID NO: 1951 - RNA, 2031 nt, synthetic construct
  misc_feature 1..2031: note = derived and/or modified CDS sequence (opt4) from DENV-4 Consensus__SSc-prME
  source 1..2031: mol_type = other RNA
atgagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcctga

SEQ ID NO: 1952 - RNA, 2031 nt, synthetic construct
  misc_feature 1..2031: note = derived and/or modified CDS sequence (opt4) from DENV-4 Consensus__SSc-prME(F108S)
  source 1..2031: mol_type = other RNA
atgagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgagcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcctga

SEQ ID NO: 1953 - RNA, 2031 nt, synthetic construct
  misc_feature 1..2031: note = derived and/or modified CDS sequence (opt4) from DENV-4 Consensus__SSc-prMEdelstem_TM-JEV
  source 1..2031: mol_type = other RNA
atgagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1954 - RNA, 1332 nt, synthetic construct
  misc_feature 1..1332: note = derived and/or modified CDS sequence (opt4) from DENV-4 Consensus__SSm-EdelTM
  source 1..1332: mol_type = other RNA
atgatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagctga

SEQ ID NO: 1955 - RNA, 2376 nt, synthetic construct
  misc_feature 1..2376: note = derived and/or modified CDS sequence (opt4) from DENV-4 Consensus__C-P2A-SSc-prME
  source 1..2376: mol_type = other RNA
atgaaccagagaaagaaggtggtgagaccccccttcaacatgctgaagagagagagaaacagagtgagcaccccccagggcctggtgaagagattcagcaccggcctgttcagcggcaagggccccctgagaatggtgctggccttcatcaccttcctgagagtgctgagcatcccccccaccgccggcatcctgaagagatggggccagctgaagaagaacaaggccatcaagatcctgatcggcttcagaaaggagatcggcagaatgctgaacatcctgaacggcagaaagagaaacttcgacctgctgaagctggccggcgacgtggagagcaaccccggccccagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcctga

SEQ ID NO: 1956 - RNA, 2043 nt, synthetic construct
  misc_feature 1..2043: note = derived and/or modified CDS sequence (opt4) from DENV-4 Consensus__SSopt-prME(F108S)
  source 1..2043: mol_type = other RNA
atgaagagaaagaagagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgagcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcctga

SEQ ID NO: 1957 - RNA, 2043 nt, synthetic construct
  misc_feature 1..2043: note = derived and/or modified CDS sequence (opt4) from DENV-4 Consensus__SSopt-prME(V96H)
  source 1..2043: mol_type = other RNA
atgaagagaaagaagagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagaccacgtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcctga

SEQ ID NO: 1958 - RNA, 2043 nt, synthetic construct
  misc_feature 1..2043: note = derived and/or modified CDS sequence (opt4) from DENV-4 Consensus__SSopt-prME(E186F)
  source 1..2043: mol_type = other RNA
atgaagagaaagaagagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcttccccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcctga

SEQ ID NO: 1959 - RNA, 2043 nt, synthetic construct
  misc_feature 1..2043: note = derived and/or modified CDS sequence (opt4) from DENV-4 Consensus__SSopt-prME(R188L)
  source 1..2043: mol_type = other RNA
atgaagagaaagaagagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccctgagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggcctga

SEQ ID NO: 1960 - RNA, 2043 nt, synthetic construct
  misc_feature 1..2043: note = derived and/or modified CDS sequence (opt4) from DENV-4 Consensus__SSopt-pr(D104A)MEdelstem_TM,(F108S)-JEV
  source 1..2043: mol_type = other RNA
atgaagagaaagaagagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagccaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgagcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1961 - RNA, 2043 nt, synthetic construct
  misc_feature 1..2043: note = derived and/or modified CDS sequence (opt4) from DENV-4 Consensus__SSopt-prMEdelstem_TM,(H261N)-JEV
  source 1..2043: mol_type = other RNA
atgaagagaaagaagagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgaacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1962 - RNA, 2043 nt, synthetic construct
  misc_feature 1..2043: note = derived and/or modified CDS sequence (opt4) from DENV-4 Consensus__SSopt-prMEdelstem_TM,(R188L,A267T)-JEV
  source 1..2043: mol_type = other RNA
atgaagagaaagaagagcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccctgagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcaccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1963 - RNA, 300 nt, synthetic construct
  misc_feature 1..300: note = derived and/or modified CDS sequence (opt4) from DENV-3 Consensus__C
  source 1..300: mol_type = other RNA
atgaacaaccagagaaagaagaccggcaagcccagcatcaacatgctgaagagagtgagaaacagagtgagcaccggcagccagctggccaagagattcagcaagggcctgctgaacggccagggccccatgaagctggtgatggccttcatcgccttcctgagattcctggccatcccccccaccgccggcgtgctggccagatggggcaccttcaagaagagcggcgccatcaaggtgctgaagggcttcaagaaggagatcagcaacatgctgagcatcatcaacaagagaaagaag

SEQ ID NO: 1964 - RNA, 342 nt, synthetic construct
  misc_feature 1..342: note = derived and/or modified CDS sequence (opt4) from DENV-3 Consensus__C-SSc
  source 1..342: mol_type = other RNA
atgaacaaccagagaaagaagaccggcaagcccagcatcaacatgctgaagagagtgagaaacagagtgagcaccggcagccagctggccaagagattcagcaagggcctgctgaacggccagggccccatgaagctggtgatggccttcatcgccttcctgagattcctggccatcccccccaccgccggcgtgctggccagatggggcaccttcaagaagagcggcgccatcaaggtgctgaagggcttcaagaaggagatcagcaacatgctgagcatcatcaacaagagaaagaagaccagcctgtgcctgatgatgatcctgcccgccgccctggcc

SEQ ID NO: 1965 - RNA, 273 nt, synthetic construct
  misc_feature 1..273: note = derived and/or modified CDS sequence (opt4) from DENV-3 Consensus__pr
  source 1..273: mol_type = other RNA
ttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagaga

SEQ ID NO: 1966 - RNA, 225 nt, synthetic construct
  misc_feature 1..225: note = derived and/or modified CDS sequence (opt4) from DENV-3 Consensus__M
  source 1..225: mol_type = other RNA
agcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgacc

SEQ ID NO: 1967 - RNA, 498 nt, synthetic construct
  misc_feature 1..498: note = derived and/or modified CDS sequence (opt4) from DENV-3 Consensus__prM
  source 1..498: mol_type = other RNA
ttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgacc

SEQ ID NO: 1968 - RNA, 1479 nt, synthetic construct
  misc_feature 1..1479: note = derived and/or modified CDS sequence (opt4) from DENV-3 Consensus__E
  source 1..1479: mol_type = other RNA
atgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcc

SEQ ID NO: 1969 - RNA, 1977 nt, synthetic construct
  misc_feature 1..1977: note = derived and/or modified CDS sequence (opt4) from DENV-3 Consensus__prME
  source 1..1977: mol_type = other RNA
ttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcc

SEQ ID NO: 1970 - RNA, 2019 nt, synthetic construct
  misc_feature 1..2019: note = derived and/or modified CDS sequence (opt4) from DENV-3 Consensus__SSc-prME
  source 1..2019: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcc

SEQ ID NO: 1971 - RNA, 1056 nt, synthetic construct
  misc_feature 1..1056: note = derived and/or modified CDS sequence (opt4) from DENV-3 Consensus__NS1
  source 1..1056: mol_type = other RNA
gacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgcc

SEQ ID NO: 1972 - RNA, 1857 nt, synthetic construct
  misc_feature 1..1857: note = derived and/or modified CDS sequence (opt4) from DENV-3 Consensus__NS3
  source 1..1857: mol_type = other RNA
agcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggagttcgccgccggcagaaag

SEQ ID NO: 1973 - RNA, 2319 nt, synthetic construct
  misc_feature 1..2319: note = derived and/or modified CDS sequence (opt4) from DENV-3 Consensus__C-prME
  source 1..2319: mol_type = other RNA
atgaacaaccagagaaagaagaccggcaagcccagcatcaacatgctgaagagagtgagaaacagagtgagcaccggcagccagctggccaagagattcagcaagggcctgctgaacggccagggccccatgaagctggtgatggccttcatcgccttcctgagattcctggccatcccccccaccgccggcgtgctggccagatggggcaccttcaagaagagcggcgccatcaaggtgctgaagggcttcaagaaggagatcagcaacatgctgagcatcatcaacaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcc

SEQ ID NO: 1974 - RNA, 45 nt, synthetic construct
  misc_feature 1..45: note = derived and/or modified CDS sequence (opt4) from DENV-3 Consensus__SSc
  source 1..45: mol_type = other RNA
atgaccagcctgtgcctgatgatgatcctgcccgccgccctggcc

SEQ ID NO: 1975 - RNA, 57 nt, synthetic construct
  misc_feature 1..57: note = derived and/or modified CDS sequence (opt4) from DENV-3 Consensus__SSopt
  source 1..57: mol_type = other RNA
atgaagagaaagaagaccagcctgtgcctgatgatgatcctgcccgccgccctggcc

SEQ ID NO: 1976 - RNA, 57 nt, synthetic construct
  misc_feature 1..57: note = derived and/or modified CDS sequence (opt4) from DENV-3 Consensus__SSm
  source 1..57: mol_type = other RNA
atgacccagaaggtggtgatcttcatcctgctgatgctggtgacccccagcatgacc

SEQ ID NO: 1977 - RNA, 1482 nt, synthetic construct
  misc_feature 1..1482: note = derived and/or modified CDS sequence (opt4) from DENV-3 Consensus__E
  source 1..1482: mol_type = other RNA
atgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1978 - RNA, 1176 nt, synthetic construct
  misc_feature 1..1176: note = derived and/or modified CDS sequence (opt4) from DENV-3 Consensus__EdelTM-variant (aa1-392)
  source 1..1176: mol_type = other RNA
atgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaag

SEQ ID NO: 1979 - RNA, 1269 nt, synthetic construct
  misc_feature 1..1269: note = derived and/or modified CDS sequence (opt4) from DENV-3 Consensus__EdelTM-variant (aa1-422)
  source 1..1269: mol_type = other RNA
atgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagctga

SEQ ID NO: 1980 - RNA, 1260 nt, synthetic construct
  misc_feature 1..1260: note = derived and/or modified CDS sequence (opt4) from DENV-3 Consensus__EdelTM-variant (aa1-419)
  source 1..1260: mol_type = other RNA
atgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggactga

SEQ ID NO: 1981 - RNA, 1155 nt, synthetic construct
  misc_feature 1..1155: note = derived and/or modified CDS sequence (opt4) from DENV-3 Consensus__Edelaa101-107
  source 1..1155: mol_type = other RNA
atgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggcttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaag

SEQ ID NO: 1982 - RNA, 1173 nt, synthetic construct
  misc_feature 1..1173: note = derived and/or modified CDS sequence (opt4) from DENV-3 Consensus__EdelTM-variant (aa1-391)
  source 1..1173: mol_type = other RNA
atgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaag

SEQ ID NO: 1983 - RNA, 2025 nt, synthetic construct
  misc_feature 1..2025: note = derived and/or modified CDS sequence (opt4) from DENV-3 Consensus__SSc-prME
  source 1..2025: mol_type = other RNA
atgaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1984 - RNA, 2025 nt, synthetic construct
  misc_feature 1..2025: note = derived and/or modified CDS sequence (opt4) from DENV-3 Consensus__SSc-prME(F108S)
  source 1..2025: mol_type = other RNA
atgaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgagcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1985 - RNA, 2025 nt, synthetic construct
  misc_feature 1..2025: note = derived and/or modified CDS sequence (opt4) from DENV-3 Consensus__SSc-prME(R186L)
  source 1..2025: mol_type = other RNA
atgaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccctgaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1986 - RNA, 2025 nt, synthetic construct
  misc_feature 1..2025: note = derived and/or modified CDS sequence (opt4) from DENV-3 Consensus__SSc-prME(A265T)
  source 1..2025: mol_type = other RNA
atgaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1987 - RNA, 2025 nt, synthetic construct
  misc_feature 1..2025: note = derived and/or modified CDS sequence (opt4) from DENV-3 Consensus__SSc-prMEdelstem_TM-JEV
  source 1..2025: mol_type = other RNA
atgaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 1988 - RNA, 1326 nt, synthetic construct
  misc_feature 1..1326: note = derived and/or modified CDS sequence (opt4) from DENV-3 Consensus__SSm-EdelTM
  source 1..1326: mol_type = other RNA
atgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagctga

SEQ ID NO: 1989 - RNA, 2373 nt, synthetic construct
  misc_feature 1..2373: note = derived and/or modified CDS sequence (opt4) from DENV-3 Consensus__C-P2A-SSc-prME
  source 1..2373: mol_type = other RNA
atgaacaaccagagaaagaagaccggcaagcccagcatcaacatgctgaagagagtgagaaacagagtgagcaccggcagccagctggccaagagattcagcaagggcctgctgaacggccagggccccatgaagctggtgatggccttcatcgccttcctgagattcctggccatcccccccaccgccggcgtgctggccagatggggcaccttcaagaagagcggcgccatcaaggtgctgaagggcttcaagaaggagatcagcaacatgctgagcatcatcaacaagagaaagaagaacttcgacctgctgaagctggccggcgacgtggagagcaaccccggccccaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1990 - RNA, 2037 nt, synthetic construct
  misc_feature 1..2037: note = derived and/or modified CDS sequence (opt4) from DENV-3 Consensus__SSopt-prME
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1991 - RNA, 2037 nt, synthetic construct
  misc_feature 1..2037: note = derived and/or modified CDS sequence (opt4) from DENV-3 Consensus__SSopt-prME(F108S)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgagcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1992 - RNA, 2037 nt, synthetic construct
  misc_feature 1..2037: note = derived and/or modified CDS sequence (opt4) from DENV-3 Consensus__SSopt-prME(H27N)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagaacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1993 - RNA, 2037 nt, synthetic construct
  misc_feature 1..2037: note = derived and/or modified CDS sequence (opt4) from DENV-3 Consensus__SSopt-prME(T76I)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccatccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1994 - RNA, 2037 nt, synthetic construct
  misc_feature 1..2037: note = derived and/or modified CDS sequence (opt4) from DENV-3 Consensus__SSopt-prME(N89D)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccaggactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1995 - RNA, 2037 nt, synthetic construct
  misc_feature 1..2037: note = derived and/or modified CDS sequence (opt4) from DENV-3 Consensus__SSopt-prME(Y96H)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacccacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1996 - RNA, 2037 nt, synthetic construct
  misc_feature 1..2037: note = derived and/or modified CDS sequence (opt4) from DENV-3 Consensus__SSopt-prME(K110E)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcgagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1997 - RNA, 2037 nt, synthetic construct
  misc_feature 1..2037: note = derived and/or modified CDS sequence (opt4) from DENV-3 Consensus__SSopt-prME(H149N)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagaaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1998 - RNA, 2037 nt, synthetic construct
  misc_feature 1..2037: note = derived and/or modified CDS sequence (opt4) from DENV-3 Consensus__SSopt-prME(S184F)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcttccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 1999 - RNA, 2037 nt, synthetic construct
  misc_feature 1..2037: note = derived and/or modified CDS sequence (opt4) from DENV-3 Consensus__SSopt-prME(R186L)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccctgaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2000 - RNA, 2037 nt, synthetic construct
  misc_feature 1..2037: note = derived and/or modified CDS sequence (opt4) from DENV-3 Consensus__SSopt-prME(N240S)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagagcgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2001 - RNA, 2037 nt, synthetic construct
  misc_feature 1..2037: note = derived and/or modified CDS sequence (opt4) from DENV-3 Consensus__SSopt-prME(M258L)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccctgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2002 - RNA, 2037 nt, synthetic construct
  misc_feature 1..2037: note = derived and/or modified CDS sequence (opt4) from DENV-3 Consensus__SSopt-prME(H259N)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgaacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2003 - RNA, 2037 nt, synthetic construct
  misc_feature 1..2037: note = derived and/or modified CDS sequence (opt4) from DENV-3 Consensus__SSopt-prME(H259R)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgagaaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2004 - RNA, 2037 nt, synthetic construct
  misc_feature 1..2037: note = derived and/or modified CDS sequence (opt4) from DENV-3 Consensus__SSopt-prME(A265T)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2005 - RNA, 2037 nt, synthetic construct
  misc_feature 1..2037: note = derived and/or modified CDS sequence (opt4) from DENV-3 Consensus__SSopt-prME(S296G)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgggctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2006 - RNA, 2037 nt, synthetic construct
  misc_feature 1..2037: note = derived and/or modified CDS sequence (opt4) from DENV-3 Consensus__SSopt-prME(S311R)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagagagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2007 - RNA, 2037 nt, synthetic construct
  misc_feature 1..2037: note = derived and/or modified CDS sequence (opt4) from DENV-3 Consensus__SSopt-prME(K321T)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaccgtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2008 - RNA, 2037 nt, synthetic construct
  misc_feature 1..2037: note = derived and/or modified CDS sequence (opt4) from DENV-3 Consensus__SSopt-prME(G28C,H242C)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcactgcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcctgcgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2009 - RNA, 2037 nt, synthetic construct
  misc_feature 1..2037: note = derived and/or modified CDS sequence (opt4) from DENV-3 Consensus__SSopt-prME(R186L,A265T)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccctgaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2010 - RNA, 2037 nt, synthetic construct
  misc_feature 1..2037: note = derived and/or modified CDS sequence (opt4) from DENV-3 Consensus__SSopt-pr(D104A)ME(F108S)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagccaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgagcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2011 - RNA, 2037 nt, synthetic construct
  misc_feature 1..2037: note = derived and/or modified CDS sequence (opt4) from DENV-3 Consensus__SSopt-pr(D104A)ME(R186L,A265T)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagccaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccctgaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2012 - RNA, 2037 nt, synthetic construct
  misc_feature 1..2037: note = derived and/or modified CDS sequence (opt4) from DENV-3 Consensus__SSopt-pr(D104A)ME(F108S,R186L,A265T)
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagccaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgagcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccctgaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2013 - RNA, 2016 nt, synthetic construct
  misc_feature 1..2016: note = derived and/or modified CDS sequence (opt4) from DENV-3 Consensus__SSopt-prMEdel101-107,(R99P,F108N)
  source 1..2016: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggaccccggcaacggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggcctga

SEQ ID NO: 2014 - RNA, 2037 nt, synthetic construct
  misc_feature 1..2037: note = derived and/or modified CDS sequence (opt4) from DENV-3 Consensus__SSopt-prMEdelstem_TM-JEV
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 2015 - RNA, 2037 nt, synthetic construct
  misc_feature 1..2037: note = derived and/or modified CDS sequence (opt4) from DENV-3 Consensus__SSopt-pr(D104A)MEdelstem_TM,(F108S)-JEV
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagccaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgagcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 2016 - RNA, 2037 nt, synthetic construct
  misc_feature 1..2037: note = derived and/or modified CDS sequence (opt4) from DENV-3 Consensus__SSopt-pr(D104A)MEdelstem_TM,(R186L,A265T)-JEV
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagccaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccctgaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 2017 - RNA, 2037 nt, synthetic construct
  misc_feature 1..2037: note = derived and/or modified CDS sequence (opt4) from DENV-3 Consensus__SSopt-pr(D104A)MEdelstem_TM,(F108S,R186L,A265T)- JEV
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagccaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgagcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccctgaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 2018 - RNA, 2037 nt, synthetic construct
  misc_feature 1..2037: note = derived and/or modified CDS sequence (opt4) from DENV-3 Consensus__SSopt-prMEdelstem_TM,(H259N)-JEV
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgaacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 2019 - RNA, 2037 nt, synthetic construct
  misc_feature 1..2037: note = derived and/or modified CDS sequence (opt4) from DENV-3 Consensus__SSopt-prMEdelstem_TM,(R186L,A265T)-JEV
  source 1..2037: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccctgaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 2020 - RNA, 2016 nt, synthetic construct
  misc_feature 1..2016: note = derived and/or modified CDS sequence (opt4) from DENV-3 Consensus__SSopt-prMEdelstem_TM,del101-107,(R99P,F108N)-JEV
  source 1..2016: mol_type = other RNA
atgaagagaaagaagaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggaccccggcaacggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcaccctgggcaaggccttcagcaccaccctgaagggcgcccagagactggccgccctgggcgacaccgcctgggacttcggcagcatcggcggcgtgttcaacagcatcggcagagccgtgcaccaggtgttcggcggcgccttcagaaccctgttcggcggcatgagctggatcacccagggcctgatgggcgccctgctgctgtggatgggcgtgaacgccagagacagaagcatcgccctggccttcctggccaccggcggcgtgctggtgttcctggccaccaacgtgcacgcctga

SEQ ID NO: 2021 - RNA, 3081 nt, synthetic construct
  misc_feature 1..3081: note = derived and/or modified CDS sequence (opt4) from DENV-3 Consensus__SSc-prME-NS1
  source 1..3081: mol_type = other RNA
atgaccagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgcctga

SEQ ID NO: 2022 - RNA, 1824 nt, synthetic construct
  misc_feature 1..1824: note = derived and/or modified CDS sequence (opt4) from DENV-3 Consensus__SSm-EdelTM-linker-ferritin
  source 1..1824: mol_type = other RNA
atgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcagcggcggcgacatcatcaagctgctgaacgagcaggtgaacaaggagatgcagagcagcaacctgtacatgagcatgagcagctggtgctacacccacagcctggacggcgccggcctgttcctgttcgaccacgccgccgaggagtacgagcacgccaagaagctgatcatcttcctgaacgagaacaacgtgcccgtgcagctgaccagcatcagcgcccccgagcacaagttcgagggcctgacccagatcttccagaaggcctacgagcacgagcagcacatcagcgagagcatcaacaacatcgtggaccacgccatcaagagcaaggaccacgccaccttcaacttcctgcagtggtacgtggccgagcagcacgaggaggaggtgctgttcaaggacatcctggacaagatcgagctgatcggcaacgagaaccacggcctgtacctggccgaccagtacgtgaagggcatcgccaagagcagaaagagctga

SEQ ID NO: 2023 - RNA, 1821 nt, synthetic construct
  misc_feature 1..1821: note = derived and/or modified CDS sequence (opt4) from DENV-3 Consensus__SStPA-WHbcAg-linker-EdelTM
  source 1..1821: mol_type = other RNA
atggacgccatgaagagaggcctgtgctgcgtgctgctgctgtgcggcgccgtgttcgtggacagcgtgaccggcatggacatcgacccctacaaggagttcggcagcagctaccagctgctgaacttcctgcccctggacttcttccccgacctgaacgccctggtggacaccgccaccgccctgtacgaggaggagctgaccggcagagagcactgcagcccccaccacaccgccatcagacaggccctggtgtgctgggacgagctgaccaagctgatcgcctggatgagcagcaacatcaccagcgagcaggtgagaaccatcatcgtgaaccacgtgaacgacacctggggcctgaaggtgagacagagcctgtggttccacctgagctgcctgaccttcggccagcacaccgtgcaggagttcctggtgagcttcggcgtgtggatcagaacccccgccccctacagaccccccaacgcccccatcctgagcaccctgcccgagcacaccgtgatctgcggcggcggcggcagcggcggcggcggcatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagctga

SEQ ID NO: 2024 - RNA, 75 nt, synthetic construct
  misc_feature 1..75: note = derived and/or modified CDS sequence (opt5) from Homo sapiens__SigSeq(TPA)/SStPA
  source 1..75: mol_type = other RNA
atggacgccatgaagagaggcctgtgctgtgtgctcctgctttgcggggctgtcttcgttgatagcgtgaccgga

SEQ ID NO: 2025 - RNA, 489 nt, synthetic construct
  misc_feature 1..489: note = derived and/or modified CDS sequence (opt5) from Helicobacter pylori J99__Ferritin
  source 1..489: mol_type = other RNA
gacatcattaagctgctcaacgaacaggtgaataaagagatgcaaagctccaacctgtacatgtctatgagctcctggtgctatacccactctcttgatggcgccgggctgttcctctttgaccatgctgccgaggaatacgagcacgcgaagaaactgatcattttccttaatgaaaacaatgtccccgttcagctgacaagcatctccgctcctgagcataagtttgagggactcacgcagattttccagaaagcctatgaacacgagcaacatatctctgaaagcatcaacaatattgtggatcacgccatcaagtccaaggaccacgctacctttaacttcctgcagtggtacgtggccgagcagcatgaggaagaggtcctgtttaaagatattctcgacaagatcgaactgattggcaatgagaaccacgggctttatctggctgatcagtacgtgaaaggaatcgccaagagcagaaaatct

SEQ ID NO: 2026 - RNA, 450 nt, synthetic construct
  misc_feature 1..450: note = derived and/or modified CDS sequence (opt5) from Woodchuck hepatitis virus__WHbcAg
  source 1..450: mol_type = other RNA
atggacatcgatccctacaaggagttcggcagctcctatcagctgctcaactttctgcctcttgacttctttccggatctgaatgccctcgtggacaccgctacagccctgtacgaagaggaacttacggggagagagcactgctctccccatcacaccgcgattcggcaagctctggtctgttgggatgaactcacaaaactgatcgcctggatgagctccaacattacctctgagcaggttcgcacaatcattgtgaatcatgtgaacgacacctggggactgaaggtcagacagagcctctggttccacctgtcctgccttacatttggccagcataccgtgcaagagttcctggtttcttttggggtgtggatccggacgcctgccccctatcgccctcccaatgctcctatcctcagcaccctgccggaacacacagtcatttgt

SEQ ID NO: 2027 - RNA, 303 nt, synthetic construct
  misc_feature 1..303: note = derived and/or modified CDS sequence (opt5) from Japanese encephalitis virus__Cterm-JEV/JEV
  source 1..303: mol_type = other RNA
ggcagcaccctggggaaggccttctccacaacgctcaaaggagctcagagactggccgcgcttggcgacaccgcttgggattttgggtctatcggaggcgtgttcaacagcattgggcgggccgtccaccaagtttttggaggcgccttccgcacactgtttggcgggatgtcctggatcacccagggactcatgggcgctctgcttctgtggatgggggtgaatgccagagaccggtctattgctctcgccttcctggcgacaggaggcgtgctggtctttctcgccaccaacgtgcatgct

SEQ ID NO: 2028 - RNA, 15 nt, synthetic construct
  misc_feature 1..15: note = derived and/or modified CDS sequence (opt5) from Artificial__MKRKK
  source 1..15: mol_type = other RNA
atgaagagaaagaaa

SEQ ID NO: 2029 - skipped

SEQ ID NO: 2030 - RNA, 27 nt, synthetic construct
  misc_feature 1..27: note = derived and/or modified CDS sequence (opt5) from Artificial__Linker(G4SG4)
  source 1..27: mol_type = other RNA
ggcgggggaggcagcgggggaggcggg

SEQ ID NO: 2031 - RNA, 51 nt, synthetic construct
  misc_feature 1..51: note = derived and/or modified CDS sequence (opt5) from Foot-and-mouth disease virus__F2A/P2A
  source 1..51: mol_type = other RNA
aacttcgacctgctcaagctggccggcgatgtggagagcaatcccgggcct

SEQ ID NO: 2032 - RNA, 300 nt, synthetic construct
  misc_feature 1..300: note = derived and/or modified CDS sequence (opt5) from DENV-1 CYD23__C
  source 1..300: mol_type = other RNA
atgaacaatcagagaaagaaaaccgcccggcccagcttcaacatgctgaagcgcgctagaaatcgggtgtccacagtctctcaactcgccaaacgctttagcaagggcctgctttccgggcagggacctatgaaactggttatggcgttcatcgcttttctcagattcctggccattccgcccacggccggcatccttgctcggtgggggtcttttaagaagaacggagccattaaagtgctgcgcggcttcaagaaagagatcagcaatatgctcaacattatgaatagacggcgcaag

SEQ ID NO: 2033 - RNA, 342 nt, synthetic construct
  misc_feature 1..342: note = derived and/or modified CDS sequence (opt5) from DENV-1 CYD23__C-SSc
  source 1..342: mol_type = other RNA
atgaacaatcagagaaagaaaaccgcccggcccagcttcaacatgctgaagcgcgctagaaatcgggtgtccacagtctctcaactcgccaaacgctttagcaagggcctgctttccgggcagggacctatgaaactggttatggcgttcatcgcttttctcagattcctggccattccgcccacggccggcatccttgctcggtgggggtcttttaagaagaacggagccattaaagtgctgcgcggcttcaagaaagagatcagcaatatgctcaacattatgaatagacggcgcaagtccgtgaccatgctgctgatgctcatgcctacagctctggcc

SEQ ID NO: 2034 - RNA, 273 nt, synthetic construct
  misc_feature 1..273: note = derived and/or modified CDS sequence (opt5) from DENV-1 CYD23__pr
  source 1..273: mol_type = other RNA
ttccacctgaccacaagaggcggggagccccatatgatcgtgagcaagcaggaacggggaaaatccctcctgtttaagacgtctgccggcgtcaacatgtgcacccttattgctatggacctgggggagctctgtgaagatacaatgacctacaaatgccctcgcatcacagaggccgaaccggacgatgttgactgttggtgcaatgcgaccgatacatgggtgacctatggaacgtgtagccaaaccggcgagcacagacgggacaagcgc

SEQ ID NO: 2035 - RNA, 225 nt, synthetic construct
  misc_feature 1..225: note = derived and/or modified CDS sequence (opt5) from DENV-1 CYD23__M
  source 1..225: mol_type = other RNA
agcgtggccctggctccccacgtcggcctcgggctggagaccagaacagaaacgtggatgtcctctgagggagcctggaagcagatccaacgggttgaaacctgggcgcttcgccatcctggcttcacagtgattgctctgtttctcgcccacgccatcgggaccagcattacacagaaaggaatcattttcatcctgcttatgctggtgaccccgtccatggct

SEQ ID NO: 2036 - RNA, 498 nt, synthetic construct
  misc_feature 1..498: note = derived and/or modified CDS sequence (opt5) from DENV-1 CYD23__prM
  source 1..498: mol_type = other RNA
ttccacctgaccacaagaggcggggagccccatatgatcgtgagcaagcaggaacggggaaaatccctcctgtttaagacgtctgccggcgtcaacatgtgcacccttattgctatggacctgggggagctctgtgaagatacaatgacctacaaatgccctcgcatcacagaggccgaaccggacgatgttgactgttggtgcaatgcgaccgatacatgggtgacctatggaacgtgtagccaaaccggcgagcacagacgggacaagcgctccgtggctctggctccccatgtcgggcttggactggagacaagaaccgaaacatggatgtctagcgagggcgcctggaaacagattcagcgggtggaaacctgggccctccgccaccctggcttcacggttatcgccctgtttctggctcatgccattgggacatccatcacccagaagggaatcattttcatcctcctgatgcttgtgacaccctctatggcg

SEQ ID NO: 2037 - RNA, 1485 nt, synthetic construct
  misc_feature 1..1485: note = derived and/or modified CDS sequence (opt5) from DENV-1 CYD23__E
  source 1..1485: mol_type = other RNA
atgagatgcgtgggcatcgggagccgggacttcgtcgagggactgtccggcgccacctgggttgatgtggtgctcgaacacgggtcttgtgtcacaacgatggctaaggacaaacccaccctggatattgagcttctgaagacagaagtgaccaaccctgccgttctccgcaaactgtgcatcgaggcgaagattagcaatacaaccacagactccagatgtccgacccagggagaagctacgcttgtggaggagcaagatgccaactttgtctgccggcgcaccttcgtggacagaggctgggggaatggatgtggcctgtttggcaaagggtctctcatcacatgcgccaagttcaagtgtgttaccaaactggaaggaaagattgtgcagtacgagaacctgaaatatagcgtcatcgtgacagtgcataccggcgatcagcaccaggtcgggaatgaatccacggagcatggaacaaccgctacaatcacaccccaagcccctaccaccgagattcagctcacggactacggcgctctgacccttgattgctctccccggacagggctggactttaacgaaatggttctcctgaccatgaaggagaaaagctggcttgtgcacaagcagtggttcctggatctccctctgccctggacatccggagccagcacctctcaggaaacgtggaatcgccaagacctgctcgtgacatttaagaccgcgcatgccaaaaagcaggaggtcgtggttctgggctcccaggaaggcgctatgcacaccgcccttacaggggctaccgagatccagacaagcggaacgaccacaattttcgccggccacctgaaatgtagactcaagatggataaactgacccttaaggggatgtcttatgtgatgtgcacaggatcctttaaactggagaaggaagtcgcggagacccaacatggcacggtgctcgttcagatcaagtacgaagggaccgacgccccttgtaaaattccgttcagcacacaggacgagaagggagtgacccaaaacggccggctgatcacagctaatcccattgtcaccgataaagaaaagcctgtgaacatcgaggccgagcccccttttggcgaatcttatatcgtcattggggctggagagaaagccctgaagctctcctggttcaagaaaggcagctccatcgggaagatgtttgaagccacggctcgcggagcgagacggatggccattctgggcgacacagcttgggatttcgggtctatcggcggagtgttcaccagcgttggcaaacttgtgcaccagatttttgggacagcctacggagtcctgttctccggcgtgagctggaccatgaagatcgggatcggagttctcctgacctggcttggcctcaattctcgctccacaagcctgtctatgacgtgcattgccgtggggctggtcaccctgtatctcggcgtgatggtgcaggct

SEQ ID NO: 2038 - RNA, 1983 nt, synthetic construct
  misc_feature 1..1983: note = derived and/or modified CDS sequence (opt5) from DENV-1 CYD23__prME
  source 1..1983: mol_type = other RNA
ttccacctgaccacaagaggcggggagccccatatgatcgtgagcaagcaggaacggggaaaatccctcctgtttaagacgtctgccggcgtcaacatgtgcacccttattgctatggacctgggggagctctgtgaagatacaatgacctacaaatgccctcgcatcacagaggccgaaccggacgatgttgactgttggtgcaatgcgaccgatacatgggtgacctatggaacgtgtagccaaaccggcgagcacagacgggacaagcgctccgtggctctggctccccatgtcgggcttggactggagacaagaaccgaaacatggatgtctagcgagggcgcctggaaacagattcagcgggtggaaacctgggccctccgccaccctggcttcacggttatcgccctgtttctggctcatgccattgggacatccatcacccagaagggaatcattttcatcctcctgatgcttgtgacaccctctatggcgatgagatgcgtcggcattgggagccgggattttgtggagggactgtccggcgccacctgggttgacgtggtcctcgagcacgggagctgtgtgaccacaatggctaaggataaacctacgctggacatcgaacttctgaagaccgaggtgacaaaccccgccgtcctccgcaaactgtgcattgaagctaagatctctaataccacaaccgattccagatgtcctacgcaaggagaggccacactggttgaggaacaggacgcgaacttcgtgtgccggcgcacctttgtggatagaggctggggcaatgggtgtggactcttcggcaaagggagcctgattacctgcgccaagtttaagtgcgtcacaaaacttgagggaaagatcgtgcagtacgaaaacctgaaatattctgttatcgtgaccgtccacacaggcgaccagcatcaagtggggaatgagtccacggaacacggaaccacagctaccattacaccgcaggcccccaccacggagatccagctcaccgactacggcgctctgacacttgattgtagccctcggaccggcctggacttcaacgaaatggttctcctgacaatgaaggagaaatcttggctggtgcataagcagtggtttctcgatctgccccttccttggacctccggggccagcacgtcccaagagacatggaatcgccaggacctgctcgtcaccttcaaaacagcccacgctaagaagcaggaagtggtcgtgctgggatctcaagagggcgcgatgcacaccgcccttaccggggctacagaaattcagacgagcggaaccacaaccatctttgccggccatctgaaatgcagactcaagatggataaactgacactgaaggggatgtcctatgttatgtgtaccggcagcttcaaactcgagaaggaagtggccgagacgcagcacggaacagtcctggtgcagattaagtacgagggcaccgacgctccctgcaaaatcccgttctctacccaagatgaaaagggggttacacagaacggacggcttatcaccgccaatcctattgtgacagacaaagagaagcccgtcaacatcgaagcggagcctccctttggcgagtcctatattgtgatcggggctggagaaaaagccctgaagctcagctggttcaagaaaggctctagcattgggaagatgtttgaggccacggctagaggcgcccgccggatggctatcctgggagataccgcctgggacttcggctccatcgggggagtgtttacatctgttggcaaactggtccatcagattttcgggaccgcgtacggagtgctttttagcggcgtgtcctggacaatgaagatcgggattggcgtcctcctgacctggctgggactcaatagcagatctacgtccctgagcatgacctgtatcgccgtgggccttgttacactgtacctcggggtgatggtccaggct

SEQ ID NO: 2039 - RNA, 2025 nt, synthetic construct
  misc_feature 1..2025: note = derived and/or modified CDS sequence (opt5) from DENV-1 CYD23__SSc-prME
  source 1..2025: mol_type = other RNA
agcgtgaccatgctgctcatgctgatgcccacagcccttgctttccacctgacgaccagaggcggggagccccatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaggaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagcctccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggct

SEQ ID NO: 2040 - RNA, 2325 nt, synthetic construct
  misc_feature 1..2325: note = derived and/or modified CDS sequence (opt5) from DENV-1 CYD23__C-prME
  source 1..2325: mol_type = other RNA
atgaacaatcagagaaagaaaaccgcccggcccagcttcaacatgctgaagcgcgctagaaatcgggtgtccacagtctctcaactcgccaaacgctttagcaagggcctgctttccgggcagggacctatgaaactggttatggcgttcatcgcttttctcagattcctggccattccgcccacggccggcatccttgctcggtgggggtcttttaagaagaacggagccattaaagtgctgcgcggcttcaagaaagagatcagcaatatgctcaacattatgaatagacggcgcaagtccgtgaccatgctgctgatgctcatgcctacagctctggcctttcaccttaccacaagagggggagaaccccatatgatcgtctctaaacaggagcggggcaagagccttctcttcaagacctccgcgggcgtgaacatgtgcacactgatcgccatggaccttggggaactgtgtgaggataccatgacgtacaaatgccctcgcattaccgaagctgagcccgacgatgttgactgttggtgcaatgccacagatacctgggtgacatatggaacctgtagccagacgggcgagcacagacgggacaagcgctctgtcgctctcgcccctcatgtggggctgggactggaaacaagaaccgagacatggatgtccagcgaaggcgcgtggaaacaaatccagcgggttgagacctgggccctcagacacccggggtttaccgtgattgctctgttccttgcccatgctatcggaacatctattacgcagaagggcatcatttttatcctgctcatgctggtcaccccctccatggccatgcgctgcgtgggcatcgggagccgggatttcgtggagggactttctggcgccacatgggtcgacgttgtgctggaacacgggtcctgtgtgaccacaatggctaaagataagcctaccctcgacattgagctgctgaaaacggaagtcacaaaccccgcggtgctcagaaagctgtgcatcgaggccaagattagcaataccaccacagattcccgctgtcctacccagggagaagctacacttgttgaggagcaagacgccaactttgtgtgccggagaacgttcgtcgatcgcggctgggggaatggatgtggcctgttcggcaaagggtctctcattacctgcgccaagtttaaatgcgtgacaaagctggaaggaaaaatcgttcagtacgagaaccttaagtatagcgtgatcgtcaccgtgcacacaggcgaccagcatcaggtcgggaatgaatccaccgagcacggaacgaccgctacaatcacaccccaagccccgaccaccgaaattcagctgacggactacggcgcgctcacactggattgtagccctcggaccgggctggacttcaacgagatggtgctcctgacaatgaaggagaaatcttggcttgttcataagcagtggtttctggatctccccctgccttggacctccggcgctagcacctctcaagaaacatggaacagacaggacctgcttgtgacgttcaaaaccgcccacgccaagaaacaggaggtcgtggttctcggaagccaggaaggcgctatgcacacagccctgaccggggctacagagatccaaacctccggaacgacaaccatttttgccggccatctgaagtgccgcctcaagatggataaactgacccttaaggggatgtcttatgtgatgtgtacaggcagcttcaaactggaaaaggaggtcgcggagacccagcacggaacagtgctcgtgcagatcaaatacgaagggacggacgccccctgcaagattcccttttccacccaggatgagaagggcgttacacaaaatggacggctgatcaccgctaaccctatcgtcacagacaaagaaaagccggtgaatattgaggccgagccccctttcggcgaaagctatatcgtgattggggctggagagaaagccctgaagctgtcttggtttaaaaagggctccagcatcgggaaaatgttcgaagcgaccgccagaggagctcgccggatggccattctcggcgatacggcttgggactttgggtctatcggcggagtcttcacctccgtgggcaagctggttcatcagatttttgggacagcctacggagtgctgttcagcggcgtctcctggaccatgaagatcgggatcggagtgctcctgacatggcttggcctgaactctagaagcacctccctctctatgacatgtattgccgttgggctggtgaccctgtaccttggcgtcatggtgcaggct

SEQ ID NO: 2041 - RNA, 45 nt, synthetic construct
  misc_feature 1..45: note = derived and/or modified CDS sequence (opt5) from DENV-1 CYD23__SSc
  source 1..45: mol_type = other RNA
atgagcgtgaccatgctgctcatgctgatgcccacagcccttgct

SEQ ID NO: 2042 - RNA, 57 nt, synthetic construct
  misc_feature 1..57: note = derived and/or modified CDS sequence (opt5) from DENV-1 CYD23__SSopt
  source 1..57: mol_type = other RNA
atgaagagaaagaaaagcgtgaccatgctgctcatgctgatgcccacagcccttgct

SEQ ID NO: 2043 - RNA, 57 nt, synthetic construct
  misc_feature 1..57: note = derived and/or modified CDS sequence (opt5) from DENV-1 CYD23__SSm
  source 1..57: mol_type = other RNA
atgacccagaagggcatcattttcatcctgctcatgctggtgacacccagcatggcc

SEQ ID NO: 2044 - RNA, 1488 nt, synthetic construct
  misc_feature 1..1488: note = derived and/or modified CDS sequence (opt5) from DENV-1 CYD23__E
  source 1..1488: mol_type = other RNA
atgagatgcgtgggcatcgggagccgggacttcgtcgagggactgtccggcgccacctgggttgatgtggtgctcgaacacgggtcttgtgtcacaacgatggctaaggacaaacccaccctggatattgagcttctgaagacagaagtgaccaaccctgccgttctccgcaaactgtgcatcgaggcgaagattagcaatacaaccacagactccagatgtccgacccagggagaagctacgcttgtggaggagcaagatgccaactttgtctgccggcgcaccttcgtggacagaggctgggggaatggatgtggcctgtttggcaaagggtctctcatcacatgcgccaagttcaagtgtgttaccaaactggaaggaaagattgtgcagtacgagaacctgaaatatagcgtcatcgtgacagtgcataccggcgatcagcaccaggtcgggaatgaatccacggagcatggaacaaccgctacaatcacaccccaagcccctaccaccgagattcagctcacggactacggcgctctgacccttgattgctctccccggacagggctggactttaacgaaatggttctcctgaccatgaaggagaaaagctggcttgtgcacaagcagtggttcctggatctccctctgccctggacatccggagccagcacctctcaggaaacgtggaatcgccaagacctgctcgtgacatttaagaccgcgcatgccaaaaagcaggaggtcgtggttctgggctcccaggaaggcgctatgcacaccgcccttacaggggctaccgagatccagacaagcggaacgaccacaattttcgccggccacctgaaatgtagactcaagatggataaactgacccttaaggggatgtcttatgtgatgtgcacaggatcctttaaactggagaaggaagtcgcggagacccaacatggcacggtgctcgttcagatcaagtacgaagggaccgacgccccttgtaaaattccgttcagcacacaggacgagaagggagtgacccaaaacggccggctgatcacagctaatcccattgtcaccgataaagaaaagcctgtgaacatcgaggccgagcccccttttggcgaatcttatatcgtcattggggctggagagaaagccctgaagctctcctggttcaagaaaggcagctccatcgggaagatgtttgaagccacggctcgcggagcgagacggatggccattctgggcgacacagcttgggatttcgggtctatcggcggagtgttcaccagcgttggcaaacttgtgcaccagatttttgggacagcctacggagtcctgttctccggcgtgagctggaccatgaagatcgggatcggagttctcctgacctggcttggcctcaattctcgctccacaagcctgtctatgacgtgcattgccgtggggctggtcaccctgtatctcggcgtgatggtgcaggcttga

SEQ ID NO: 2045 - RNA, 1182 nt, synthetic construct
  misc_feature 1..1182: note = derived and/or modified CDS sequence (opt5) from DENV-1 CYD23__EdelTM-variant (aa1-394)
  source 1..1182: mol_type = other RNA
atgagatgcgtgggcatcgggagccgggacttcgtcgagggactgtccggcgccacctgggttgatgtggtgctcgaacacgggtcttgtgtcacaacgatggctaaggacaaacccaccctggatattgagcttctgaagacagaagtgaccaaccctgccgttctccgcaaactgtgcatcgaggcgaagattagcaatacaaccacagactccagatgtccgacccagggagaagctacgcttgtggaggagcaagatgccaactttgtctgccggcgcaccttcgtggacagaggctgggggaatggatgtggcctgtttggcaaagggtctctcatcacatgcgccaagttcaagtgtgttaccaaactggaaggaaagattgtgcagtacgagaacctgaaatatagcgtcatcgtgacagtgcataccggcgatcagcaccaggtcgggaatgaatccacggagcatggaacaaccgctacaatcacaccccaagcccctaccaccgagattcagctcacggactacggcgctctgacccttgattgctctccccggacagggctggactttaacgaaatggttctcctgaccatgaaggagaaaagctggcttgtgcacaagcagtggttcctggatctccctctgccctggacatccggagccagcacctctcaggaaacgtggaatcgccaagacctgctcgtgacatttaagaccgcgcatgccaaaaagcaggaggtcgtggttctgggctcccaggaaggcgctatgcacaccgcccttacaggggctaccgagatccagacaagcggaacgaccacaattttcgccggccacctgaaatgtagactcaagatggataaactgacccttaaggggatgtcttatgtgatgtgcacaggatcctttaaactggagaaggaagtcgcggagacccaacatggcacggtgctcgttcagatcaagtacgaagggaccgacgccccttgtaaaattccgttcagcacacaggacgagaagggagtgacccaaaacggccggctgatcacagctaatcccattgtcaccgataaagaaaagcctgtgaacatcgaggccgagcccccttttggcgaatcttatatcgtcattggggctggagagaaagccctgaagctctcctggttcaagaaa

SEQ ID NO: 2046 - RNA, 1275 nt, synthetic construct
  misc_feature 1..1275: note = derived and/or modified CDS sequence (opt5) from DENV-1 CYD23__EdelTM-variant (aa1-424)
  source 1..1275: mol_type = other RNA
atgagatgcgtgggcatcgggagccgggacttcgtcgagggactgtccggcgccacctgggttgatgtggtgctcgaacacgggtcttgtgtcacaacgatggctaaggacaaacccaccctggatattgagcttctgaagacagaagtgaccaaccctgccgttctccgcaaactgtgcatcgaggcgaagattagcaatacaaccacagactccagatgtccgacccagggagaagctacgcttgtggaggagcaagatgccaactttgtctgccggcgcaccttcgtggacagaggctgggggaatggatgtggcctgtttggcaaagggtctctcatcacatgcgccaagttcaagtgtgttaccaaactggaaggaaagattgtgcagtacgagaacctgaaatatagcgtcatcgtgacagtgcataccggcgatcagcaccaggtcgggaatgaatccacggagcatggaacaaccgctacaatcacaccccaagcccctaccaccgagattcagctcacggactacggcgctctgacccttgattgctctccccggacagggctggactttaacgaaatggttctcctgaccatgaaggagaaaagctggcttgtgcacaagcagtggttcctggatctccctctgccctggacatccggagccagcacctctcaggaaacgtggaatcgccaagacctgctcgtgacatttaagaccgcgcatgccaaaaagcaggaggtcgtggttctgggctcccaggaaggcgctatgcacaccgcccttacaggggctaccgagatccagacaagcggaacgaccacaattttcgccggccacctgaaatgtagactcaagatggataaactgacccttaaggggatgtcttatgtgatgtgcacaggatcctttaaactggagaaggaagtcgcggagacccaacatggcacggtgctcgttcagatcaagtacgaagggaccgacgccccttgtaaaattccgttcagcacacaggacgagaagggagtgacccaaaacggccggctgatcacagctaatcccattgtcaccgataaagaaaagcctgtgaacatcgaggccgagcccccttttggcgaatcttatatcgtcattggggctggagagaaagccctgaagctctcctggttcaagaaaggcagctccatcgggaagatgtttgaagccacggctcgcggagcgagacggatggccattctgggcgacacagcttgggatttcgggtcttga

SEQ ID NO: 2047 - RNA, 1266 nt, synthetic construct
  misc_feature 1..1266: note = derived and/or modified CDS sequence (opt5) from DENV-1 CYD23__EdelTM-variant (aa1-421)
  source 1..1266: mol_type = other RNA
atgagatgcgtgggcatcgggagccgggacttcgtcgagggactgtccggcgccacctgggttgatgtggtgctcgaacacgggtcttgtgtcacaacgatggctaaggacaaacccaccctggatattgagcttctgaagacagaagtgaccaaccctgccgttctccgcaaactgtgcatcgaggcgaagattagcaatacaaccacagactccagatgtccgacccagggagaagctacgcttgtggaggagcaagatgccaactttgtctgccggcgcaccttcgtggacagaggctgggggaatggatgtggcctgtttggcaaagggtctctcatcacatgcgccaagttcaagtgtgttaccaaactggaaggaaagattgtgcagtacgagaacctgaaatatagcgtcatcgtgacagtgcataccggcgatcagcaccaggtcgggaatgaatccacggagcatggaacaaccgctacaatcacaccccaagcccctaccaccgagattcagctcacggactacggcgctctgacccttgattgctctccccggacagggctggactttaacgaaatggttctcctgaccatgaaggagaaaagctggcttgtgcacaagcagtggttcctggatctccctctgccctggacatccggagccagcacctctcaggaaacgtggaatcgccaagacctgctcgtgacatttaagaccgcgcatgccaaaaagcaggaggtcgtggttctgggctcccaggaaggcgctatgcacaccgcccttacaggggctaccgagatccagacaagcggaacgaccacaattttcgccggccacctgaaatgtagactcaagatggataaactgacccttaaggggatgtcttatgtgatgtgcacaggatcctttaaactggagaaggaagtcgcggagacccaacatggcacggtgctcgttcagatcaagtacgaagggaccgacgccccttgtaaaattccgttcagcacacaggacgagaagggagtgacccaaaacggccggctgatcacagctaatcccattgtcaccgataaagaaaagcctgtgaacatcgaggccgagcccccttttggcgaatcttatatcgtcattggggctggagagaaagccctgaagctctcctggttcaagaaaggcagctccatcgggaagatgtttgaagccacggctcgcggagcgagacggatggccattctgggcgacacagcttgggattga

SEQ ID NO: 2048 - RNA, 2031 nt, synthetic construct
  misc_feature 1..2031: note = derived and/or modified CDS sequence (opt5) from DENV-1 CYD23__SSc-prME
  source 1..2031: mol_type = other RNA
atgagcgtgaccatgctgctcatgctgatgcccacagcccttgctttccacctgacgaccagaggcggggagccccatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaggaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagcctccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggcttga

SEQ ID NO: 2049 - RNA, 2031 nt, synthetic construct
  misc_feature 1..2031: note = derived and/or modified CDS sequence (opt5) from DENV-1 CYD23__SSc-prME(F108S)
  source 1..2031: mol_type = other RNA
atgagcgtgaccatgctgctcatgctgatgcccacagcccttgctttccacctgacgaccagaggcggggagccccatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaggaacaggacgctaacttcgtgtgccggcgcacatttgtcgatagaggctggggcaatgggtgtggactctctggcaaagggtccctgattacctgcgccaagttcaagtgcgtgacaaaacttgagggaaagatcgttcagtacgaaaacctgaaatatagcgtgatcgtcacggtgcacaccggcgaccagcatcaagttgggaatgagtctacagaacacggaaccacagctaccattacgccccaggcccctaccacagagatccagctcaccgactacggcgccctgacactggattgtagcccccggaccggcctcgactttaacgaaatggtgctgcttacgatgaaggagaaatcctggctggtccataagcagtggttcctcgatctgcctcttccctggacatccggggcttctaccagccaagagacatggaatcgccaggacctgctcgtgacctttaaaaccgcgcacgccaagaagcaggaagtcgtggttctgggatcccaagagggcgctatgcacacagccctgacgggggccaccgaaattcagacaagcggaaccacaaccatcttcgctggccatctcaaatgcagactgaagatggataaacttacgctgaaggggatgtcttatgtgatgtgtacaggctcctttaaactcgagaaggaagtcgccgagacccagcacggaaccgtgctggttcagattaagtacgagggcacagacgcgccgtgcaaaatccctttcagcacccaagatgaaaagggggtgacacagaacggacggctgatcacggctaatcccattgtcaccgacaaagagaagcctgtgaacatcgaagccgagcctcccttcggcgagtcttatattgtgatcggggccggagaaaaagctcttaagctcagctggtttaagaaaggctcctctattgggaagatgttcgaggccacagctagaggcgcccgccggatggcgatcctgggagataccgcctgggactttggcagcatcgggggagttttcacatccgtcggcaaactggtgcatcagatttttgggaccgcttacggagtcctcttcagcggcgtgtcttggacgatgaagatcgggattggcgtgctgcttacctggctgggactcaattccagaagcacatctctgtccatgacctgtatcgccgttggcctggtgacactttacctcggggtcatggtgcaggcttga

SEQ ID NO: 2050 - RNA, 2031 nt, synthetic construct
  misc_feature 1..2031: note = derived and/or modified CDS sequence (opt5) from DENV-1 CYD23__SSc-prMEdelstem_TM-JEV
  source 1..2031: mol_type = other RNA
atgagcgtgaccatgctgctcatgctgatgcccacagcccttgctttccacctgacgaccagaggcggggagccccatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaggaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagcctccctttggcgagagctatattgtgatcggggccggagaaaaagctcttaagctctcttggttcaagaaaggcagcacactggggaaggccttttccaccacactgaaaggcgctcagagactcgccgcgctgggagataccgcctgggacttcggctctattgggggagtttttaatagcatcggccgcgctgtccatcaggtgttcgggggagcctttcggacgcttttcggcgggatgtcctggatcacccaaggcctgatgggagctctcctgctgtggatgggcgtgaacgccagagatcgcagcattgcgcttgcctttctcgctacagggggagtcctggtgttcctggccaccaatgttcacgcttga

SEQ ID NO: 2051 - RNA, 2379 nt, synthetic construct
  misc_feature 1..2379: note = derived and/or modified CDS sequence (opt5) from DENV-1 CYD23__C-P2A-SSc-prME
  source 1..2379: mol_type = other RNA
atgaacaatcagagaaagaaaaccgcccggcccagcttcaacatgctgaagcgcgctagaaatcgggtgtccacagtctctcaactcgccaaacgctttagcaagggcctgctttccgggcagggacctatgaaactggttatggcgttcatcgcttttctcagattcctggccattccgcccacggccggcatccttgctcggtgggggtcttttaagaagaacggagccattaaagtgctgcgcggcttcaagaaagagatcagcaatatgctcaacattatgaatagacggcgcaagaactttgacctgctgaaactcgctggggatgtggaatccaatcctggaccctctgtcaccatgctgcttatgctgatgcctacagccctcgcgttccacctgaccacaagaggcggcgagccccatatgatcgtgagcaagcaggaacgggggaagtcccttctgtttaaaaccagcgccggagttaacatgtgcacactcatcgctatggacctgggcgagctgtgtgaagataccatgacgtacaagtgccctcgcattaccgaggccgagccggacgatgtggactgttggtgcaatgctacagatacctgggtcacatatgggacctgttctcagacgggagaacacagacgggacaaacgctccgtggccctcgcgccccatgttggcctggggcttgagacaagaaccgaaacatggatgagctctgagggagcctggaagcaaatccagcgggtggagacctgggctctgagacaccctggcttcaccgtcattgccctctttctggctcatgccatcggcacatccattacgcagaaagggatcattttcatccttctgatgctcgtgacccccagcatggccatgcgctgcgtgggaatcggctctcgggattttgtcgaagggctgtccggagctacatgggttgacgtggtgctggagcacggcagctgtgtcaccacaatggcgaaggataaacctaccctcgacattgaactgcttaagacggaggtgacaaaccccgccgttctgagaaagctctgcatcgaagctaaaatttccaataccaccacagattctcgctgtccgacccagggggaggccacactggtggaggaacaagacgccaacttcgtctgccggagaacgttcgtggaccgcggatggggcaatggctgtgggctttttggaaagggcagcctgcttacctgcgctaaattcaagtgcgttacaaaactggaggggaagatcgtgcagtacgaaaacctgaagtattccgtcattgtgaccgtccacacaggagatcagcatcaggtgggcaacgagagcaccgaacacgggacgaccgccacaatcacccctcaagcgcccacaaccgagatccagctcacggactacggcgctctgacacttgattgttctcctcggaccggactggactttaatgagatggttctcctgacaatgaaagaaaagtcctggctggtgcataaacagtggttccttgatctccccctgccctggaccagcggcgcctctaccagccaagagacatggaacagacaggacctgctcgtcacgtttaagaccgcccacgctaaaaagcaggaagtggttgtgctggggtcccaggagggagccatgcacacagctcttaccggcgccacagaaattcaaacctctgggacgacaaccatcttcgcgggacatctgaagtgccgcctcaaaatggataagctgaccctgaaaggcatgagctatgtcatgtgtacagggtcctttaagctcgagaaagaggtggccgaaacccagcacggcacagtgctcgttcagattaagtacgagggaacggacgctccttgcaagatcccgttcagcacccaggatgaaaaaggcgtcacacaaaatgggcggctgattaccgccaaccccatcgtgacagacaaggagaaacctgtgaatatcgaggctgaacccccttttggagagtcttatattgtcatcggcgccggggaaaaggcgctgaaactctcctggttcaagaaaggaagctctattggcaagatgtttgaggccaccgctagaggggcccgccggatggctatcctgggcgatacggcctgggacttcggatccattggcggggtgtttaccagcgttggaaaacttgtgcatcagatcttcggcacagcctacggggtcctgttctccggagtgtcttggaccatgaagattggcatcggggttctcctgacatggctgggccttaacagcagatccacctctctcagcatgacatgtatcgctgtgggactggtcaccctgtacctcggcgtgatggttcaggcgtga

SEQ ID NO: 2052 - RNA, 2043 nt, synthetic construct
  misc_feature 1..2043: note = derived and/or modified CDS sequence (opt5) from DENV-1 CYD23__SSopt-prME(F108S)
  source 1..2043: mol_type = other RNA
atgaagcgcaaaaagagcgtgaccatgctgctcatgctgatgcccacagcccttgctttccacctgacgacccggggcggggagccccatatgatcgtctccaaacaggaacgcggaaagtctctcctgtttaaaacaagcgccggcgttaacatgtgcacccttattgcgatggacctgggggagctctgtgaagatacaatgacctacaagtgcccgagaatcacagaggctgaacccgacgatgtggactgttggtgcaatgccaccgatacgtgggtgacctatggaacatgttcccaaaccggcgagcaccggcgcgacaagagatctgtcgccctggctcctcatgtggggctgggactcgagacacggaccgaaacgtggatgagctccgagggcgcctggaaacagattcagcgcgttgaaacatgggctctgagacaccccggcttcaccgtgatcgccctttttctggcgcatgccattgggacatctatcacccagaagggaatcattttcatcctcctgatgcttgtcacccctagcatggctatgcggtgcgtgggcattgggtcccgcgattttgttgagggactgagcggcgccacatgggtggacgtcgtgctcgagcacgggtcttgtgtgacgaccatggctaaagataagcccacactggacatcgaactgctcaaaaccgaggtcacaaaccctgccgttctgagaaagctctgcattgaagcgaagatctccaataccacgacagatagccggtgtccgacccaaggagaggccaccctggtggaggagcaggacgctaacttcgtgtgccgcagaacatttgtcgatcggggctggggcaatgggtgtggactctctggcaaagggtccctgattacctgcgccaagttcaaatgcgtgacaaaacttgagggaaagatcgttcagtacgaaaacctgaagtatagcgtgatcgtcacggtgcacaccggcgaccagcatcaagttgggaatgagtctacagaacacggaaccacagctaccattacgccccaggcccctaccacagagatccagctcaccgactacggcgccctgacactggattgttcccccagaaccggcctcgactttaacgaaatggtgctgcttacgatgaaagaaaagagctggctggtccataagcagtggttcctcgatctgcctcttccctggacatccggggcttctaccagccaagagacatggaatagacaggacctgctcgtgacctttaaaaccgcgcacgccaagaaacaggaagtcgtggttctgggatcccaagagggcgctatgcacacagccctgacgggggccaccgaaattcagacaagcggaaccacaaccatcttcgctggccatctcaagtgccggctgaaaatggataaacttacgctgaaggggatgtcttatgtgatgtgtacaggctcctttaagctcgagaaggaagtcgccgagacccagcacggaaccgtgctggttcagattaaatacgagggcacagacgcgccgtgcaagatccctttcagcacccaagatgaaaaaggggtgacacagaacggaagactgatcacggctaatcccattgtcaccgacaaggagaagcctgtgaacatcgaagccgagcctcccttcggcgagtcttatattgtgatcggggccggagaaaaagctcttaagctcagctggtttaaaaagggctcctctattgggaaaatgttcgaggccacagctcgcggcgcccggagaatggcgatcctgggagataccgcctgggactttggcagcatcgggggagttttcacatccgtcggcaagctggtgcatcagatttttgggaccgcttacggagtgcttttcagcggcgtctcttggacgatgaagatcgggattggcgtgctgcttacctggctgggactcaattcccgcagcacatctctgtccatgacctgtatcgccgttggcctggtgacactttacctcggggtcatggtgcaggcttga

SEQ ID NO: 2053 - RNA, 2043 nt, synthetic construct
  misc_feature 1..2043: note = derived and/or modified CDS sequence (opt5) from DENV-1 CYD23__SSopt-prME(F96H)
  source 1..2043: mol_type = other RNA
atgaagcggaaaaagagcgtgaccatgctgctcatgctgatgcccacagcccttgctttccacctgacgaccagaggcggggagccccatatgatcgtctccaaacaggaacgcggaaagtctctcctgtttaaaacaagcgccggcgttaacatgtgcacccttattgcgatggacctgggggagctctgtgaagatacaatgacctacaagtgcccgagaatcacagaggctgaacccgacgatgtggactgttggtgcaatgccaccgatacgtgggtgacctatggaacatgttcccaaaccggcgagcaccggcgcgacaagagatctgtcgccctggctcctcatgtggggctgggactcgagacacggaccgaaacgtggatgagctccgagggcgcctggaaacagattcagcgcgttgaaacatgggctctgagacaccccggcttcaccgtgatcgccctttttctggcgcatgccattgggacatctatcacccagaagggaatcattttcatcctcctgatgcttgtcacccctagcatggctatgcggtgcgtgggcattgggtcccgcgattttgttgagggactgagcggcgccacatgggtggacgtcgtgctcgagcacgggtcttgtgtgacgaccatggctaaagataagcccacactggacatcgaactgctcaaaaccgaggtcacaaaccctgccgttctgagaaagctctgcattgaagcgaagatctccaataccacgacagatagccggtgtccgacccaaggagaggccaccctggtggaggaacaggacgctaacttcgtgtgccgcagaacacacgtcgatcggggctggggcaatgggtgtggactctttggcaaagggtctctgattacctgcgccaagttcaaatgcgtgacaaaacttgagggaaagatcgttcagtacgaaaacctgaagtattccgtgatcgtcacggtgcataccggcgaccagcaccaagttgggaatgagagcacagaacatggaaccacagctaccattacgccccaggcccctaccacagagatccagctcaccgactacggcgccctgacactggattgttctccccgcaccggcctcgactttaacgaaatggtgctgcttacgatgaaagagaagtcctggctggtccacaagcagtggttcctcgatctgcctcttccctggacaagcggggcttccacctctcaagagacatggaatagacaggacctgctcgtgacctttaaaaccgcgcacgccaagaaacaggaagtcgtggttctgggaagccaagagggcgctatgcatacagccctgacgggggccaccgaaattcagacatccggaaccacaaccatcttcgctggccacctcaagtgccggctgaaaatggataaacttacgctgaaggggatgagctatgtgatgtgtacaggctcttttaagctcgagaaggaagtcgccgagacccagcatggaaccgtgctggttcagattaaatacgagggcacagacgcgccgtgcaagatccctttctccacccaagatgaaaaaggggtgacacagaacggaagactgatcacggctaatcccattgtcaccgacaaggagaagcctgtgaacatcgaagccgagcctcccttcggcgagagctatattgtgatcggggccggagaaaaagctcttaagctctcttggtttaaaaagggcagctccattgggaaaatgttcgaggccacagctcgcggcgcccggagaatggcgatcctgggagataccgcctgggactttggctctatcgggggagttttcacaagcgtcggcaagctggtgcaccagatttttgggaccgcttacggagtgcttttctccggcgtcagctggacgatgaagatcgggattggcgtgctgcttacctggctgggactcaattctcgctccacaagcctgtctatgacctgtatcgccgttggcctggtgacactttacctcggggtcatggtgcaggcttga

SEQ ID NO: 2054 - RNA, 2043 nt, synthetic construct
  misc_feature 1..2043: note = derived and/or modified CDS sequence (opt5) from DENV-1 CYD23__SSopt-prME(S186F)
  source 1..2043: mol_type = other RNA
atgaagcggaaaaagagcgtgaccatgctgctcatgctgatgcccacagcccttgctttccacctgacgaccagaggcggggagccccatatgatcgtctccaaacaggaacgcggaaagtctctcctgtttaaaacaagcgccggcgttaacatgtgcacccttattgcgatggacctgggggagctctgtgaagatacaatgacctacaagtgcccgagaatcacagaggctgaacccgacgatgtggactgttggtgcaatgccaccgatacgtgggtgacctatggaacatgttcccaaaccggcgagcaccggcgcgacaagagatctgtcgccctggctcctcatgtggggctgggactcgagacacggaccgaaacgtggatgagctccgagggcgcctggaaacagattcagcgcgttgaaacatgggctctgagacaccccggcttcaccgtgatcgccctttttctggcgcatgccattgggacatctatcacccagaagggaatcattttcatcctcctgatgcttgtcacccctagcatggctatgcggtgcgtgggcattgggtcccgcgattttgttgagggactgagcggcgccacatgggtggacgtcgtgctcgagcacgggtcttgtgtgacgaccatggctaaagataagcccacactggacatcgaactgctcaaaaccgaggtcacaaaccctgccgttctgagaaagctctgcattgaagcgaagatctccaataccacgacagatagccggtgtccgacccaaggagaggccaccctggtggaggaacaggacgctaacttcgtgtgccgcagaacatttgtcgatcggggctggggcaatgggtgtggactcttcggcaaagggtctctgattacctgcgccaagtttaaatgcgtgacaaaacttgagggaaagatcgttcagtacgaaaacctgaagtattccgtgatcgtcacggtgcacaccggcgaccagcatcaagttgggaatgagagcacagaacacggaaccacagctaccattacgccccaggcccctaccacagagatccagctcaccgactacggcgccctgacactggattgtttcccccgcaccggcctcgactttaacgaaatggtgctgcttacgatgaaagagaagtcttggctggtccataagcagtggttcctcgatctgcctcttccctggacatccggggctagcacctcccaagagacatggaatagacaggacctgctcgtgacctttaaaaccgcgcacgccaagaaacaggaagtcgtggttctgggatctcaagagggcgctatgcacacagccctgacgggggccaccgaaattcagacaagcggaaccacaaccatcttcgctggccatctcaagtgccggctgaaaatggataaacttacgctgaaggggatgtcctatgtgatgtgtacaggcagcttcaagctcgagaaggaagtcgccgagacccagcacggaaccgtgctggttcagattaaatacgagggcacagacgcgccgtgcaagatccctttttctacccaagatgaaaaaggggtgacacagaacggaagactgatcacggctaatcccattgtcaccgacaaggagaagcctgtgaacatcgaagccgagcctcccttcggcgagtcctatattgtgatcggggccggagaaaaagctcttaagctcagctggtttaaaaagggctctagcattgggaaaatgttcgaggccacagctcgcggcgcccggagaatggcgatcctgggagataccgcctgggactttggctccatcgggggagttttcacatctgtcggcaagctggtgcatcagatttttgggaccgcttacggagtgcttttcagcggcgtctcctggacgatgaagatcgggattggcgtgctgcttacctggctgggactcaatagccgctctacatccctgagcatgacctgtatcgccgttggcctggtgacactttacctcggggtcatggtgcaggcttga

SEQ ID NO: 2055 - RNA, 2043 nt, synthetic construct
  misc_feature 1..2043: note = derived and/or modified CDS sequence (opt5) from DENV-1 CYD23__SSopt-prME(R188L)
  source 1..2043: mol_type = other RNA
atgaagcggaaaaagagcgtgaccatgctgctcatgctgatgcccacagcccttgctttccacctgacgaccagaggcggggagccccatatgatcgtctccaaacaggaacgcggaaagtctctcctgtttaaaacaagcgccggcgttaacatgtgcacccttattgcgatggacctgggggagctctgtgaagatacaatgacctacaagtgcccgagaatcacagaggctgaacccgacgatgtggactgttggtgcaatgccaccgatacgtgggtgacctatggaacatgttcccaaaccggcgagcaccggcgcgacaagagatctgtcgccctggctcctcatgtggggctgggactcgagacacggaccgaaacgtggatgagctccgagggcgcctggaaacagattcagcgcgttgaaacatgggctctgagacaccccggcttcaccgtgatcgccctttttctggcgcatgccattgggacatctatcacccagaagggaatcattttcatcctcctgatgcttgtcacccctagcatggctatgcggtgcgtgggcattgggtcccgcgattttgttgagggactgagcggcgccacatgggtggacgtcgtgctcgagcacgggtcttgtgtgacgaccatggctaaagataagcccacactggacatcgaactgctcaaaaccgaggtcacaaaccctgccgttctgagaaagctgtgcattgaagcgaagatctccaataccacgacagatagccggtgtccgacccaaggagaggccaccctggtggaggaacaggacgctaacttcgtgtgccgcagaacatttgtcgatcggggctggggcaatgggtgtggactcttcggcaaagggtctctgattacctgcgccaagtttaaatgcgtgacaaaacttgagggaaagatcgttcagtacgaaaacctgaagtattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctcccctcaccggcctggacttcaacgaaatggtgcttctgacgatgaaagagaagtcctggctcgtccataagcagtggtttctggatcttcctctgccctggacaagcggggcttccacctctcaagagacatggaatcgccaggacctcctggtgaccttcaaaaccgcgcacgccaagaaacaggaagtcgtggttctgggaagccaagagggcgctatgcacacagccctcacgggggccaccgaaattcagacatccggaaccacaaccatctttgctggccatctgaagtgcagacttaaaatggataagctgacgctcaaggggatgagctatgtgatgtgtacaggctctttcaaactggagaaggaagtcgccgagacccagcacggaaccgtgctggttcagattaaatacgagggcacagacgcgccgtgcaagatccctttctccacccaagatgaaaaaggggtgacacagaacggacggcttatcacggctaatcccattgtcaccgacaaggagaagcctgtgaacatcgaagccgagcctccctttggcgagagctatattgtgatcggggccggagaaaaagctctcaagctgtcttggttcaaaaagggcagctccattgggaaaatgtttgaggccacagctagaggcgcccgccggatggcgatcctgggagataccgcctgggacttcggctctatcgggggagtttttacaagcgtcggcaagctcgtgcatcagattttcgggaccgcttacggagtgctgttttccggcgtcagctggacgatgaagatcgggattggcgtgcttctgacctggctcggacttaattctagatccacaagcctgtctatgacctgtatcgccgttggccttgtgacactctacctgggggtcatggtgcaggcttga

SEQ ID NO: 2056 - RNA, 2043 nt, synthetic construct
  misc_feature 1..2043: note = derived and/or modified CDS sequence (opt5) from DENV-1 CYD23__SSopt-pr(D104A)MEdelstem_TM,(F108S)-JEV
  source 1..2043: mol_type = other RNA
atgaagcgcaaaaagagcgtgaccatgctgctcatgctgatgcccacagcccttgctttccacctgacgacccggggcggggagccccatatgatcgtctccaaacaggaacgcggaaagtctctcctgtttaaaacaagcgccggcgttaacatgtgcacccttattgcgatggacctgggggagctctgtgaagatacaatgacctacaagtgcccgagaatcacagaggctgaacccgacgatgtggactgttggtgcaatgccaccgatacgtgggtgacctatggaacatgttcccaaaccggcgagcaccggcgcgccaagagatctgtcgctctggcccctcatgtggggctgggactcgagacacggaccgaaacgtggatgagctccgagggcgcttggaaacagattcagcgcgttgaaacatgggccctgagacaccccggcttcaccgtgatcgcgctttttctggcccatgctattgggacatctatcacccagaagggaatcattttcatcctcctgatgcttgtcacccctagcatggccatgcggtgcgtgggcattgggtcccgcgactttgttgagggactgagcggcgctacatgggtggatgtcgtgctcgagcacgggtcttgtgtgacgaccatggccaaagacaagcccacactggatatcgaactgctcaaaaccgaggtcacaaaccctgcggttctgagaaaactttgcattgaagccaagatctccaataccacgacagacagccggtgtccgacccaaggagaggctaccctggtggaggagcaggatgccaacttcgtgtgccgcagaacatttgtcgaccggggctggggcaatgggtgtggactctctggcaaagggtccctgattacctgcgctaagttcaaatgcgtgacaaaacttgagggaaagatcgttcagtacgaaaacctgaagtatagcgtgatcgtcacggtgcacaccggcgatcagcatcaagttgggaatgagtctacagaacacggaaccacagccaccattacgccccaggcccctaccacagagatccagctcaccgactacggcgctctgacactggactgttcccccagaaccggcctcgattttaacgaaatggtgctgcttacgatgaaagaaaagagctggctggtccataagcagtggttcctcgacctgcctcttccctggacatccggggcgtctaccagccaagagacatggaatagacaggatctgctcgtgacctttaaaaccgcccacgctaagaaacaggaagtcgtggttctgggatcccaagagggcgccatgcacacagccctgacgggggctaccgaaattcagacaagcggaaccacaaccatcttcgccggccatctcaagtgccggctgaaaatggacaaacttacgctgaaggggatgtcttatgtgatgtgtacaggctcctttaagctcgagaaggaagtcgcggagacccagcacggaaccgtgctggttcagattaaatacgagggcacagatgctccgtgcaagatccctttcagcacccaagacgaaaaaggggtgacacagaacggaagactgatcacggccaatcccattgtcaccgataaggagaagcctgtgaacatcgaagccgagcctcccttcggcgagtcttatattgtgatcggggctggagaaaaagcccttaagctcagctggtttaaaaagggctccacactggggaaggctttctctaccacactgaagggcgcccagcgcctcgcggccctgggagacaccgcttgggattttggcagcattgggggagttttcaattccatcggccgggccgtccatcaggtgtttgggggagctttcagaacgctttttggcgggatgagctggatcacccaaggcctgatgggagccctcctgctgtggatgggcgtgaacgcgcgcgaccggtctattgcccttgctttcctcgccacagggggagtcctggtgtttctggctaccaatgttcacgcctga

SEQ ID NO: 2057 - RNA, 2043 nt, synthetic construct
  misc_feature 1..2043: note = derived and/or modified CDS sequence (opt5) from DENV-1 CYD23__SSopt-prMEdelstem_TM,(H261N)-JEV
  source 1..2043: mol_type = other RNA
atgaagcggaaaaagagcgtgaccatgctgctcatgctgatgcccacagcccttgctttccacctgacgaccagaggcggggagccccatatgatcgtctccaaacaggaacgcggaaagtctctcctgtttaaaacaagcgccggcgttaacatgtgcacccttattgcgatggacctgggggagctctgtgaagatacaatgacctacaagtgcccgagaatcacagaggctgaacccgacgatgtggactgttggtgcaatgccaccgatacgtgggtgacctatggaacatgttcccaaaccggcgagcaccggcgcgacaagagatctgtcgccctggctcctcatgtggggctgggactcgagacacggaccgaaacgtggatgagctccgagggcgcctggaaacagattcagcgcgttgaaacatgggctctgagacaccccggcttcaccgtgatcgccctttttctggcgcatgccattgggacatctatcacccagaagggaatcattttcatcctcctgatgcttgtcacccctagcatggctatgcggtgcgtgggcattgggtcccgcgattttgttgagggactgagcggcgccacatgggtggacgtcgtgctcgagcacgggtcttgtgtgacgaccatggctaaagataagcccacactggacatcgaactgctcaaaaccgaggtcacaaaccctgccgttctgagaaaactttgcattgaagcgaagatctccaataccacgacagatagccggtgtccgacccaaggagaggccaccctggtggaggaacaggacgctaacttcgtgtgccgcagaacatttgtcgatcggggctggggcaatgggtgtggactcttcggcaaggggtctctgattacctgcgccaagtttaaatgcgtgacaaaacttgagggaaagatcgttcagtacgaaaacctgaagtattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccgcaccggcctcgacttcaacgaaatggtgctgcttacgatgaaagagaagtcctggctggtccataagcagtggtttctcgatctgcctcttccctggacaagcggggcttccacctctcaagagacatggaatagacaggacctgctcgtgaccttcaaaaccgcgcacgccaagaaacaggaagtcgtggttctgggaagccaagagggcgctatgaacacagccctgacgggggccaccgaaattcagacatccggaaccacaaccatctttgctggccacctcaagtgccggctgaaaatggataaacttacgctgaaggggatgagctatgtgatgtgtacaggctctttcaagctcgagaaggaagtcgccgagacccagcatggaaccgtgctggttcagattaaatacgagggcacagacgcgccgtgcaagatccctttctccacccaagatgaaaaaggggtgacacagaatggaagactgatcacggctaaccccattgtcaccgacaaggagaagcctgtgaatatcgaagccgagcctccctttggcgagagctatattgtgatcggggccggagaaaaagctcttaagctctcttggttcaaaaagggcagcacactggggaaagccttttccaccacactgaagggcgctcagcgcctcgccgcgctgggagataccgcctgggacttcggctctattgggggagtttttaacagcatcggccgggctgtccaccaggtgttcgggggagcctttagaacgcttttcggcgggatgtcctggatcacccaaggcctgatgggagctctcctgctgtggatgggcgtgaatgcccgcgatcggagcattgcgcttgcctttctcgctacagggggagtcctggtgttcctggccaccaacgttcatgcttga

SEQ ID NO: 2058 - RNA, 2043 nt, synthetic construct
  misc_feature 1..2043: note = derived and/or modified CDS sequence (opt5) from DENV-1 CYD23__SSopt-prMEdelstem_TM,(R188L,A267T)-JEV
  source 1..2043: mol_type = other RNA
atgaagcggaaaaagagcgtgaccatgctgctcatgctgatgcccacagcccttgctttccacctgacgaccagaggcggggagccccatatgatcgtctccaaacaggaacgcggaaagtctctcctgtttaaaacaagcgccggcgttaacatgtgcacccttattgcgatggacctgggggagctctgtgaagatacaatgacctacaagtgcccgagaatcacagaggctgaacccgacgatgtggactgttggtgcaatgccaccgatacgtgggtgacctatggaacatgttcccaaaccggcgagcaccggcgcgacaagagatctgtcgccctggctcctcatgtggggctgggactcgagacacggaccgaaacgtggatgagctccgagggcgcctggaaacagattcagcgcgttgaaacatgggctctgagacaccccggcttcaccgtgatcgccctttttctggcgcatgccattgggacatctatcacccagaagggaatcattttcatcctcctgatgcttgtcacccctagcatggctatgcggtgcgtgggcattgggtcccgcgattttgttgagggactgagcggcgccacatgggtggacgtcgtgctcgagcacgggtcttgtgtgacgaccatggctaaagataagcccacactggacatcgaactgctcaaaaccgaggtcacaaaccctgccgttctgagaaaactttgcattgaagcgaagatctccaataccacgacagatagccggtgtccgacccaaggagaggccaccctggtggaggaacaggacgctaacttcgtgtgccgcagaacatttgtcgatcggggctggggcaatgggtgtggactcttcggcaaagggtctctgattacctgcgccaagtttaaatgcgtgacaaaacttgagggaaagatcgttcagtacgaaaacctgaagtattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctcccctcaccggcctggacttcaacgaaatggtgcttctgacgatgaaagagaagtcctggctcgtccataagcagtggtttctggatcttcctctgccctggacaagcggggcttccacctctcaagagacatggaatcgccaggacctcctggtgaccttcaaaaccgcgcacgccaagaaacaggaagtcgtggttctgggaagccaagagggcgctatgcacacagccctcacggggaccacagaaattcagacctccggaacaaccacgatctttgccggccatctgaagtgcagacttaaaatggataagctgacactcaaggggatgagctatgtgatgtgtaccggctctttcaaactggagaaggaagtcgctgagacccagcacggaacagtgctggttcagattaaatacgagggcaccgacgccccgtgcaagatccctttctccacacaagatgaaaaaggggtgacgcagaacggacggcttatcaccgcgaatcccattgtcacagacaaggagaagcctgtgaacatcgaagctgagcctccctttggcgagagctatattgtgatcggggccggagaaaaagccctcaagctgtcttggttcaaaaagggcagcaccctggggaaggctttttccacaaccctcaagggcgcccagagactggctgcccttggagatacggcgtgggacttcggctctattgggggagtttttaatagcatcggccgcgccgtccatcaggtgttcgggggagcttttcggaccctgttcggcgggatgtcctggatcacacaaggcctcatgggagccctgctgctttggatgggcgtgaacgctagagatcgcagcattgccctcgcgtttctggccaccgggggagtcctggtgttcctcgctacaaatgttcacgcctga

SEQ ID NO: 2059 - RNA, 300 nt, synthetic construct
  misc_feature 1..300: note = derived and/or modified CDS sequence (opt5) from DENV-2 CYD2-T__C
  source 1..300: mol_type = other RNA
atgaacaatcagagaaagaaagccaagaacacccccttcaatatgctgaaacgggagcgcaacagagtgagcacagtccaacagctcacgaagcggttttccctgggcatgcttcaggggcgcggacctctgaaactcttcatggctctggttgcctttcttagattcctgaccatcccgcccacagcgggcattctcaagcggtgggggaccatcaagaaatctaaggctattaatgtgctgcgcggatttagaaaagaaatcggccggatgctgaacattctcaatcgcagacggcgc

SEQ ID NO: 2060 - RNA, 342 nt, synthetic construct
  misc_feature 1..342: note = derived and/or modified CDS sequence (opt5) from DENV-2 CYD2-T__C-SSc
  source 1..342: mol_type = other RNA
atgaacaatcagagaaagaaagccaagaacacccccttcaatatgctgaaacgggagcgcaacagagtgagcacagtccaacagctcacgaagcggttttccctgggcatgcttcaggggcgcggacctctgaaactcttcatggctctggttgcctttcttagattcctgaccatcccgcccacagcgggcattctcaagcggtgggggaccatcaagaaatctaaggctattaatgtgctgcgcggatttagaaaagaaatcggccggatgctgaacattctcaatcgcagacggcgcagcgccgggatgatcatcatgctgattcctacagtgatggcc

SEQ ID NO: 2061 - RNA, 273 nt, synthetic construct
  misc_feature 1..273: note = derived and/or modified CDS sequence (opt5) from DENV-2 CYD2-T__pr
  source 1..273: mol_type = other RNA
ttccacctgaccacaagaaacggcgagccccatatgatcgtgagccggcaggaaaaggggaaatccctcctgtttaagacggaggacggagtcaatatgtgcacccttatggccatggatctgggcgaactctgtgaggacacaattacctacaaatgccctctgcttcgccaaaacgaaccggaggatatcgactgttggtgcaattctacaagcacctgggttacatatgggacctgtacgaccatgggagagcacagacgggaaaagcgc

SEQ ID NO: 2062 - RNA, 225 nt, synthetic construct
  misc_feature 1..225: note = derived and/or modified CDS sequence (opt5) from DENV-2 CYD2-T__M
  source 1..225: mol_type = other RNA
agcgtggccctggtcccccacgttggcatggggctcgagaccagaacagaaacgtggatgtcctctgagggagcttggaagcatgtgcagcggatcgaaacctggattctgcgccaccctggcttcacaatgatggccgcgatccttgcttacaccattgggacaacccattttcaaagagccctgatcttcattctcctgacagccgtgaccccgagcatgacg

SEQ ID NO: 2063 - RNA, 498 nt, synthetic construct
  misc_feature 1..498: note = derived and/or modified CDS sequence (opt5) from DENV-2 CYD2-T__prM
  source 1..498: mol_type = other RNA
ttccacctgaccacaagaaacggcgagccccatatgatcgtgagccggcaggaaaaggggaaatccctcctgtttaagacggaggacggagtcaatatgtgcacccttatggccatggatctgggcgaactctgtgaggacacaattacctacaaatgccctctgcttcgccaaaacgaaccggaggatatcgactgttggtgcaattctacaagcacctgggttacatatgggacctgtacgaccatgggagagcacagacgggaaaagcgctccgtggctctggtgccccatgtcggcatggggctcgagacaagaaccgaaacatggatgtctagcgagggagcctggaaacacgtgcagcggattgagacctggatcctgcgccatcctggcttcacgatgatggcggctattctggcctacacaatcggcaccacacactttcagagagccctcatcttcattctgcttaccgctgttaccccctccatgaca

SEQ ID NO: 2064 - RNA, 1485 nt, synthetic construct
  misc_feature 1..1485: note = derived and/or modified CDS sequence (opt5) from DENV-2 CYD2-T__E
  source 1..1485: mol_type = other RNA
atgagatgcatcggcatgagcaaccgggacttcgtggagggggtctccggaggctcttgggttgatattgtgctggaacacgggagctgtgtgaccacaatggccaagaataaacccacgctcgactttgagctgatcaagaccgaagctaaacagcctgccacacttcgcaagtactgcattgaggcgaaactgaccaacacaaccacagaatccagatgtccgacccaaggagagccctctctcaatgaggaacaggataagcggttcgtctgcaagcatagcatggtggaccgcggctgggggaacggatgtggcctgtttggcaaagggggaatcgttacgtgcgctatgttcagatgtaagaaaaatatggagggcaaggtggtccagcctgaaaaccttgagtataccattgtgatcacaccccactccggggaggaacatgccgttggaaatgataccggcaaacacgggaaggagatcaagattacacctcagtctagcatcaccgaagccgagctgacgggatacggcacagtgaccatggaatgcagcccccggacaggcctcgactttaacgagatggtcctgctgcaaatggagaataaggcttggctcgtgcatcgccagtggttcctggatcttcctctgccgtggctccccggggccgacacccagggatccaactggattcagaaagaaaccctggtgacatttaaaaatcctcacgctaagaaacaagatgtcgttgtgcttggctctcaggagggggccatgcacacggcgctgaccggagccacagaaatccagatgtccagcggcaacctcctgttcaccgggcatctgaagtgtagactccggatggacaaactgcagcttaagggaatgtcttattccatgtgcacaggcaagtttaaagtggtcaaggagattgctgaaacccaacacggcacgatcgtgattcgcgttcagtacgagggggatggaagcccctgtaaaatccctttcgagatcatggacctggaaaagagacatgtgctcggccggctgattacagtcaatcccatcgtgaccgagaaagattctccggttaacattgaagccgagcctccctttggggactcctatatcattatcggagtggaacctggccagcttaagctgaattggttcaagaaagggagctccatcggccaaatgtttgagaccacaatgcgcggagctaagagaatggccattctcggcgacaccgcgtgggatttcgggtctctgggaggcgtcttcacaagcatcgggaaagccctgcaccaggtgtttggagctatttacggcgccgctttctccggggtcagctggacgatgaagatcctcattggcgtgatcatcacctggattggaatgaactctcggtccacaagcctgtctgttacccttgtgctggtcggcatcgtgacactctatctgggggttatggtgcaggcc

SEQ ID NO: 2065 - RNA, 1983 nt, synthetic construct
  misc_feature 1..1983: note = derived and/or modified CDS sequence (opt5) from DENV-2 CYD2-T__prME
  source 1..1983: mol_type = other RNA
ttccacctgaccacaagaaatggcgagccccatatgatcgtgagccggcaggaaaaggggaaatccctcctgtttaagacggaggacggagtcaatatgtgcacccttatggccatggatctgggcgaactctgtgaggacacaattacctacaaatgccctctgcttcgccaaaacgaaccggaggatatcgactgttggtgcaattctacaagcacctgggttacatatgggacctgtacgaccatgggagagcacagacgggaaaagcgctccgtggctctggtgccccatgtcggcatggggctcgagacaagaaccgaaacatggatgtctagcgagggagcctggaaacacgtgcagcggattgagacctggatcctgcgccatcctggcttcacgatgatggcggctattctggcctacacaatcggcaccacacactttcagagagccctcatcttcattctgcttaccgctgttaccccctccatgacaatgcggtgcatcgggatgtctaaccgcgattttgtggaaggagtcagcggcgggtcctgggtggacattgttctggagcacggaagctgtgtgacgaccatggccaagaataagcctacactcgatttcgaactgatcaaaaccgaggctaagcagcccgccacacttagaaaatattgcattgaagcgaagctgaccaacacgacaaccgagtctcggtgtcctacccaaggcgagccgtccctcaatgaggaacaggacaaacgctttgtctgcaagcatagcatggtggatagagggtggggaaacggctgtggcctgttcgggaagggaggcatcgtgacatgcgccatgtttcggtgcaaaaagaatatggaagggaaagtcgttcagcccgagaacctggaatacaccattgtgatcacacctcactctggagaggagcatgctgtgggcaatgacacggggaagcacggaaaagaaatcaagattacaccccagtccagcatcaccgaggccgaactcaccggctatggcacagtcaccatggagtgttctcctcgcacggggctggatttcaacgaaatggtgcttctgcaaatggagaataaggcttggctcgttcacagacagtggtttctggaccttcccctgccgtggctccctggagccgatacccagggctccaactggattcagaaagagacactggtgaccttcaagaatccccatgcgaaaaagcaagacgtcgtggttctggggagccaggaaggagccatgcacacagctctcaccggcgccacggagatccagatgtcctctgggaacctgctttttacaggccatctgaaatgccggctcagaatggacaagctgcaacttaaaggaatgagctactccatgtgtaccggcaagttcaaggtggtcaaagaaattgctgagacacagcacgggaccatcgtgatccgcgtccagtatgagggagatggcagcccttgcaagattcccttcgaaatcatggacctggagaaacggcatgtgctcgggagactgattaccgttaaccccatcgtgacagaaaaggattctcctgtcaatattgaggccgaaccgccctttggagactcctacatcatcattggcgtggagcctgggcagctgaaactcaactggttcaagaagggcagctctatcggacaaatgtttgagacgaccatgcgcggcgccaaacggatggctattctgggggatacagcgtgggacttcggaagccttggcggggtttttacctccatcggaaaggccctgcaccaggtgttcggcgctatttacggggccgccttttctggcgtcagctggacaatgaaaatcctcattggagtgatcatcacctggattggcatgaactccagaagcacgtctctgtccgtgacactggttcttgtcgggatcgtgaccctctatctgggagtgatggtccaggct

SEQ ID NO: 2066 - RNA, 2025 nt, synthetic construct
  misc_feature 1..2025: note = derived and/or modified CDS sequence (opt5) from DENV-2 CYD2-T__SSc-prME
  source 1..2025: mol_type = other RNA
agcgccggcatgatcattatgctgatccccaccgtgatggctttccacctcacaacgagaaacggggagcctcatatgattgtctcccggcaggaaaagggaaaatctctgctttttaagaccgaggacggcgttaatatgtgcacactgatggccatggatctcggggaactgtgtgaggacaccatcacatacaaatgcccgcttctgcgccaaaacgaacccgaggatattgactgttggtgcaatagcacctccacatgggtgacctatggaacgtgtaccacaatgggcgagcacagacgggaaaagcgctctgtggcgctcgtccctcatgtggggatgggactggagaccagaacagaaacctggatgagctccgagggcgcttggaaacacgttcagcggatcgagacgtggatcctgcgccatcccggcttcacaatgatggccgccattctcgcttacaccatcgggacaacccactttcagagagccctgattttcatccttctgaccgctgtgacaccttctatgacgatgcggtgcattggaatgagcaaccgcgattttgtcgaaggcgtgtccgggggaagctgggttgacatcgtgctcgagcacggctcttgtgtcaccacaatggccaagaataagcccaccctggatttcgaacttattaaaacagaggcgaagcagcctgccaccctgagaaaatattgcatcgaagctaagctcacgaacacaaccaccgagtcccggtgtccgacacaaggggagcccagcctgaatgaggaacaggacaaacgctttgtgtgcaagcattctatggtggatagaggatggggcaacggctgtgggctgttcggaaagggcgggatcgttacctgcgccatgtttcggtgcaaaaagaatatggaaggaaaagtcgtgcagcctgagaacctcgaatacacaattgtgatcacgccccactccggcgaggagcatgctgtcgggaatgacaccggaaagcacggcaaagaaattaagatcacacctcagagctctattaccgaggccgaactgacaggctatgggaccgtgacgatggagtgtagcccccgcaccggacttgatttcaacgaaatggttctgctccaaatggagaataaagcgtggctggtgcacagacagtggtttcttgacctgccgctcccttggctgcccggcgccgatacacaggggtccaactggatccagaaggagaccctggtcacattcaagaatcctcatgctaaaaagcaagacgtggttgtgctcggatcccaggaaggcgccatgcacaccgctctgacgggggccacagagatccagatgtctagcggcaaccttctgtttaccggacatctcaaatgccggctgagaatggacaagctgcaactgaaaggcatgtcctacagcatgtgtacagggaagttcaaggtcgtgaaagaaattgccgagacccagcacggaaccatcgtcattcgcgtgcagtatgagggcgatgggtctccctgcaagatccccttcgaaattatggacctcgagaaacggcatgttctgggaagactgatcacagtgaaccctatcgtcacggaaaaggattccccggtgaatattgaggctgaacccccttttggcgacagctacatcattatcggggttgagcccggccagctcaaactgaactggttcaagaagggatctagcattggccaaatgtttgagaccacaatgcgcggggcgaaacggatggccatccttggagataccgcttgggacttcggctcccttgggggagtgtttacatctattggcaaggccctccaccaggtcttcggggccatctacggcgctgcctttagcggagtgtcctggaccatgaaaatcctgattggcgtgatcattacgtggatcgggatgaatagcagatctacatccctgagcgttacccttgtcctcgtgggaattgtgaccctgtatctgggcgtcatggtgcaggcg

SEQ ID NO: 2067 - RNA, 2325 nt, synthetic construct
  misc_feature 1..2325: note = derived and/or modified CDS sequence (opt5) from DENV-2 CYD2-T__C-prME
  source 1..2325: mol_type = other RNA
atgaacaatcagagaaagaaagccaagaacacccccttcaatatgctgaaacgggagcgcaacagagtgagcacagtccaacagctcacgaagcggttttccctgggcatgcttcaggggcgcggacctctgaaactcttcatggctctggttgcctttcttagattcctgaccatcccgcccacagcgggcattctcaagcggtgggggaccatcaagaaatctaaggctattaatgtgctgcgcggatttagaaaagaaatcggccggatgctgaacattctcaatcgcagacggcgcagcgccgggatgatcatcatgctgattcctacagtgatggccttccaccttaccacaagaaacggagagccccatatgatcgtctcccggcaggaaaagggcaaatctctgctctttaagaccgaggacggcgtgaatatgtgcacgctgatggctatggatcttggggaactgtgtgaggacaccattacatacaagtgccctctcctgcgccaaaacgagcccgaagatatcgactgttggtgcaatagcacctccacatgggttacctatggaacgtgtacaaccatgggcgagcacagacgggagaaaagatctgtggccctggtccctcatgtggggatgggactcgagacacgcaccgagacctggatgagctccgaaggcgcttggaagcacgttcagcggattgagacatggatcctgagacatccggggttcacgatgatggccgcgattcttgcctacaccatcggaacaacccactttcagcgcgctctgatcttcattctcctgacagccgtgacccccagcatgacgatgcggtgcatcggcatgtctaacagagattttgtcgaaggcgtgtccgggggaagctgggtggacattgtccttgagcacggctcttgtgttacaaccatggctaaaaataagcctaccctggatttcgaactcatcaaaacagaggccaagcagcccgcgaccctgcgcaaatattgcattgaggccaagctgacaaacacgaccacagaatcccggtgtcctacccaaggggagcccagcctcaatgaagaacaggacaagagatttgtgtgcaaacattctatggtggatcgcggatggggcaacgggtgtggactgttcggcaagggcgggatcgtcacatgcgctatgttccggtgcaaaaagaacatggaaggaaaagtggttcagccggagaatcttgagtacaccatcgtgattacgcctcactccggcgaggaacatgccgtcgggaacgacaccggaaagcacggcaaggaaatcaaaattacaccccagagctccatcaccgaggctgaactgacagggtatggcaccgtgacgatggagtgttctcctagaacaggactcgattttaatgagatggttctgcttcaaatggaaaacaaggcctggctggtgcaccgccagtggttcctcgacctgcccctgccctggctccctggcgccgatacccaggggagcaattggattcaaaaagagacactggtcacctttaagaacccgcatgctaaaaagcaggacgtggtcgtgcttggatcccaggaaggcgcgatgcacaccgccctgacaggggctacggagatccagatgagctctggaaatctcctgttcaccggccatctgaagtgccggcttagaatggacaaactccaactgaaggggatgtcctacagcatgtgtacaggcaaatttaaggttgtgaaagagatcgccgaaacccagcacggaacaattgtcatccgggtgcagtatgagggcgatgggtctccctgcaagattcctttcgaaatcatggacctggagaagcgccatgttctcggaagactgattaccgtgaaccccatcgtcacggaaaaagatagccctgtgaatattgaggccgagcccccgtttggcgactcctacatcatcattggggtggaacctggacagcttaagctgaactggttcaaaaagggctctagcatcgggcaaatgtttgagacaaccatgcggggcgctaaaagaatggccattctcggagataccgcgtgggacttcggctcccttgggggagtttttacaagcatcggcaaggctctgcaccaggtcttcggggccatttacggagccgctttttctggcgtgtcctggaccatgaaaatcctgatcggggtgattatcacatggattggcatgaatagccgctctacgtccctcagcgtcaccctggtgctggttggaatcgtgacactctatctgggcgtcatggtgcaggcc

SEQ ID NO: 2068 - RNA, 45 nt, synthetic construct
  misc_feature 1..45: note = derived and/or modified CDS sequence (opt5) from DENV-2 CYD2-T__SSc
  source 1..45: mol_type = other RNA
atgagcgccggcatgatcattatgctgatccccaccgtgatggct

SEQ ID NO: 2069 - RNA, 57 nt, synthetic construct
  misc_feature 1..57: note = derived and/or modified CDS sequence (opt5) from DENV-2 CYD2-T__SSopt
  source 1..57: mol_type = other RNA
atgaagagaaagaaaagcgccggcatgatcattatgctgatccccaccgtgatggct

SEQ ID NO: 2070 - RNA, 57 nt, synthetic construct
  misc_feature 1..57: note = derived and/or modified CDS sequence (opt5) from DENV-2 CYD2-T__SSm
  source 1..57: mol_type = other RNA
atgttccagagagccctgatctttattctcctgaccgctgtgacacccagcatgacg

SEQ ID NO: 2071 - RNA, 1488 nt, synthetic construct
  misc_feature 1..1488: note = derived and/or modified CDS sequence (opt5) from DENV-2 CYD2-T__E
  source 1..1488: mol_type = other RNA
atgagatgcatcggcatgagcaaccgggacttcgtggagggggtctccggaggctcttgggttgatattgtgctggaacacgggagctgtgtgaccacaatggccaagaataaacccacgctcgactttgagctgatcaagaccgaagctaaacagcctgccacacttcgcaagtactgcattgaggcgaaactgaccaacacaaccacagaatccagatgtccgacccaaggagagccctctctcaatgaggaacaggataagcggttcgtctgcaagcatagcatggtggaccgcggctgggggaacggatgtggcctgtttggcaaagggggaatcgttacgtgcgctatgttcagatgtaagaaaaatatggagggcaaggtggtccagcctgaaaaccttgagtataccattgtgatcacaccccactccggggaggaacatgccgttggaaatgataccggcaaacacgggaaggagatcaagattacacctcagtctagcatcaccgaagccgagctgacgggatacggcacagtgaccatggaatgcagcccccggacaggcctcgactttaacgagatggtcctgctgcaaatggagaataaggcttggctcgtgcatcgccagtggttcctggatcttcctctgccgtggctccccggggccgacacccagggatccaactggattcagaaagaaaccctggtgacatttaaaaatcctcacgctaagaaacaagatgtcgttgtgcttggctctcaggagggggccatgcacacggcgctgaccggagccacagaaatccagatgtccagcggcaacctcctgttcaccgggcatctgaagtgtagactccggatggacaaactgcagcttaagggaatgtcttattccatgtgcacaggcaagtttaaagtggtcaaggagattgctgaaacccaacacggcacgatcgtgattcgcgttcagtacgagggggatggaagcccctgtaaaatccctttcgagatcatggacctggaaaagagacatgtgctcggccggctgattacagtcaatcccatcgtgaccgagaaagattctccggttaacattgaagccgagcctccctttggggactcctatatcattatcggagtggaacctggccagcttaagctgaattggttcaagaaagggagctccatcggccaaatgtttgagaccacaatgcgcggagctaagagaatggccattctcggcgacaccgcgtgggatttcgggtctctgggaggcgtcttcacaagcatcgggaaagccctgcaccaggtgtttggagctatttacggcgccgctttctccggggtcagctggacgatgaagatcctcattggcgtgatcatcacctggattggaatgaactctcggtccacaagcctgtctgttacccttgtgctggtcggcatcgtgacactctatctgggggttatggtgcaggcctga

SEQ ID NO: 2072 - RNA, 1182 nt, synthetic construct
  misc_feature 1..1182: note = derived and/or modified CDS sequence (opt5) from DENV-2 CYD2-T__EdelTM-variant (aa1-394)
  source 1..1182: mol_type = other RNA
atgagatgcatcggcatgagcaaccgggacttcgtggagggggtctccggaggctcttgggttgatattgtgctggaacacgggagctgtgtgaccacaatggccaagaataaacccacgctcgactttgagctgatcaagaccgaagctaaacagcctgccacacttcgcaagtactgcattgaggcgaaactgaccaacacaaccacagaatccagatgtccgacccaaggagagccctctctcaatgaggaacaggataagcggttcgtctgcaagcatagcatggtggaccgcggctgggggaacggatgtggcctgtttggcaaagggggaatcgttacgtgcgctatgttcagatgtaagaaaaatatggagggcaaggtggtccagcctgaaaaccttgagtataccattgtgatcacaccccactccggggaggaacatgccgttggaaatgataccggcaaacacgggaaggagatcaagattacacctcagtctagcatcaccgaagccgagctgacgggatacggcacagtgaccatggaatgcagcccccggacaggcctcgactttaacgagatggtcctgctgcaaatggagaataaggcttggctcgtgcatcgccagtggttcctggatcttcctctgccgtggctccccggggccgacacccagggatccaactggattcagaaagaaaccctggtgacatttaaaaatcctcacgctaagaaacaagatgtcgttgtgcttggctctcaggagggggccatgcacacggcgctgaccggagccacagaaatccagatgtccagcggcaacctcctgttcaccgggcatctgaagtgtagactccggatggacaaactgcagcttaagggaatgtcttattccatgtgcacaggcaagtttaaagtggtcaaggagattgctgaaacccaacacggcacgatcgtgattcgcgttcagtacgagggggatggaagcccctgtaaaatccctttcgagatcatggacctggaaaagagacatgtgctcggccggctgattacagtcaatcccatcgtgaccgagaaagattctccggttaacattgaagccgagcctccctttggggactcctatatcattatcggagtggaacctggccagcttaagctgaattggttcaagaaa

SEQ ID NO: 2073 - RNA, 1272 nt, synthetic construct
  misc_feature 1..1272: note = derived and/or modified CDS sequence (opt5) from DENV-2 CYD2-T__EdelTM-variant (aa1-424)
  source 1..1272: mol_type = other RNA
atgagatgcatcggcatgagcaaccgggacttcgtggagggggtctccggaggctcttgggttgatattgtgctggaacacgggagctgtgtgaccacaatggccaagaataaacccacgctcgactttgagctgatcaagaccgaagctaaacagcctgccacacttcgcaagtactgcattgaggcgaaactgaccaacacaaccacagaatccagatgtccgacccaaggagagccctctctcaatgaggaacaggataagcggttcgtctgcaagcatagcatggtggaccgcggctgggggaacggatgtggcctgtttggcaaagggggaatcgttacgtgcgctatgttcagatgtaagaaaaatatggagggcaaggtggtccagcctgaaaaccttgagtataccattgtgatcacaccccactccggggaggaacatgccgttggaaatgataccggcaaacacgggaaggagatcaagattacacctcagtctagcatcaccgaagccgagctgacgggatacggcacagtgaccatggaatgcagcccccggacaggcctcgactttaacgagatggtcctgctgcaaatggagaataaggcttggctcgtgcatcgccagtggttcctggatcttcctctgccgtggctccccggggccgacacccagggatccaactggattcagaaagaaaccctggtgacatttaaaaatcctcacgctaagaaacaagatgtcgttgtgcttggctctcaggagggggccatgcacacggcgctgaccggagccacagaaatccagatgtccagcggcaacctcctgttcaccgggcatctgaagtgtagactccggatggacaaactgcagcttaagggaatgtcttattccatgtgcacaggcaagtttaaagtggtcaaggagattgctgaaacccaacacggcacgatcgtgattcgcgttcagtacgagggggatggaagcccctgtaaaatccctttcgagatcatggacctggaaaagagacatgtgctcggccggctgattacagtcaatcccatcgtgaccgagaaagattctccggttaacattgaagccgagcctccctttggggactcctatatcattatcggagtggaacctggccagcttaagctgaattggttcaagaaagggagctccatcggccaaatgtttgagaccacaatgcgcggagctaagagaatggccattctcggcgacaccgcgtgggatttcgggtct

SEQ ID NO: 2074 - RNA, 1263 nt, synthetic construct
  misc_feature 1..1263: note = derived and/or modified CDS sequence (opt5) from DENV-2 CYD2-T__EdelTM-variant (aa1-421)
  source 1..1263: mol_type = other RNA
atgagatgcatcggcatgagcaaccgggacttcgtggagggggtctccggaggctcttgggttgatattgtgctggaacacgggagctgtgtgaccacaatggccaagaataaacccacgctcgactttgagctgatcaagaccgaagctaaacagcctgccacacttcgcaagtactgcattgaggcgaaactgaccaacacaaccacagaatccagatgtccgacccaaggagagccctctctcaatgaggaacaggataagcggttcgtctgcaagcatagcatggtggaccgcggctgggggaacggatgtggcctgtttggcaaagggggaatcgttacgtgcgctatgttcagatgtaagaaaaatatggagggcaaggtggtccagcctgaaaaccttgagtataccattgtgatcacaccccactccggggaggaacatgccgttggaaatgataccggcaaacacgggaaggagatcaagattacacctcagtctagcatcaccgaagccgagctgacgggatacggcacagtgaccatggaatgcagcccccggacaggcctcgactttaacgagatggtcctgctgcaaatggagaataaggcttggctcgtgcatcgccagtggttcctggatcttcctctgccgtggctccccggggccgacacccagggatccaactggattcagaaagaaaccctggtgacatttaaaaatcctcacgctaagaaacaagatgtcgttgtgcttggctctcaggagggggccatgcacacggcgctgaccggagccacagaaatccagatgtccagcggcaacctcctgttcaccgggcatctgaagtgtagactccggatggacaaactgcagcttaagggaatgtcttattccatgtgcacaggcaagtttaaagtggtcaaggagattgctgaaacccaacacggcacgatcgtgattcgcgttcagtacgagggggatggaagcccctgtaaaatccctttcgagatcatggacctggaaaagagacatgtgctcggccggctgattacagtcaatcccatcgtgaccgagaaagattctccggttaacattgaagccgagcctccctttggggactcctatatcattatcggagtggaacctggccagcttaagctgaattggttcaagaaagggagctccatcggccaaatgtttgagaccacaatgcgcggagctaagagaatggccattctcggcgacaccgcgtgggat

SEQ ID NO: 2075 - RNA, 2031 nt, synthetic construct
  misc_feature 1..2031: note = derived and/or modified CDS sequence (opt5) from DENV-2 CYD2-T__SSc-prME
  source 1..2031: mol_type = other RNA
atgagcgccggcatgatcattatgctgatccccaccgtgatggctttccacctcacaacgagaaacggggagcctcatatgattgtctcccggcaggaaaagggaaaatctctgctttttaagaccgaggacggcgttaatatgtgcacactgatggccatggatctcggggaactgtgtgaggacaccatcacatacaaatgcccgcttctgcgccaaaacgaacccgaggatattgactgttggtgcaatagcacctccacatgggtgacctatggaacgtgtaccacaatgggcgagcacagacgggaaaagcgctctgtggcgctcgtccctcatgtggggatgggactggagaccagaacagaaacctggatgagctccgagggcgcttggaaacacgttcagcggatcgagacgtggatcctgcgccatcccggcttcacaatgatggccgccattctcgcttacaccatcgggacaacccactttcagagagccctgattttcatccttctgaccgctgtgacaccttctatgacgatgcggtgcattggaatgagcaaccgcgattttgtcgaaggcgtgtccgggggaagctgggttgacatcgtgctcgagcacggctcttgtgtcaccacaatggccaagaataagcccaccctggatttcgaacttattaaaacagaggcgaagcagcctgccaccctgagaaaatattgcatcgaagctaagctcacgaacacaaccaccgagtcccggtgtccgacacaaggggagcccagcctgaatgaggaacaggacaaacgctttgtgtgcaagcattctatggtggatagaggatggggcaacggctgtgggctgttcggaaagggcgggatcgttacctgcgccatgtttcggtgcaaaaagaatatggaaggaaaagtcgtgcagcctgagaacctcgaatacacaattgtgatcacgccccactccggcgaggagcatgctgtcgggaatgacaccggaaagcacggcaaagaaattaagatcacacctcagagctctattaccgaggccgaactgacaggctatgggaccgtgacgatggagtgtagcccccgcaccggacttgatttcaacgaaatggttctgctccaaatggagaataaagcgtggctggtgcacagacagtggtttcttgacctgccgctcccttggctgcccggcgccgatacacaggggtccaactggatccagaaggagaccctggtcacattcaagaatcctcatgctaaaaagcaagacgtggttgtgctcggatcccaggaaggcgccatgcacaccgctctgacgggggccacagagatccagatgtctagcggcaaccttctgtttaccggacatctcaaatgccggctgagaatggacaagctgcaactgaaaggcatgtcctacagcatgtgtacagggaagttcaaggtcgtgaaagaaattgccgagacccagcacggaaccatcgtcattcgcgtgcagtatgagggcgatgggtctccctgcaagatccccttcgaaattatggacctcgagaaacggcatgttctgggaagactgatcacagtgaaccctatcgtcacggaaaaggattccccggtgaatattgaggctgaacccccttttggcgacagctacatcattatcggggttgagcccggccagctcaaactgaactggttcaagaagggatctagcattggccaaatgtttgagaccacaatgcgcggggcgaaacggatggccatccttggagataccgcttgggacttcggctcccttgggggagtgtttacatctattggcaaggccctccaccaggtcttcggggccatctacggcgctgcctttagcggagtgtcctggaccatgaaaatcctgattggcgtgatcattacgtggatcgggatgaatagcagatctacatccctgagcgttacccttgtcctcgtgggaattgtgaccctgtatctgggcgtcatggtgcaggcgtga

SEQ ID NO: 2076 - RNA, 2031 nt, synthetic construct
  misc_feature 1..2031: note = derived and/or modified CDS sequence (opt5) from DENV-2 CYD2-T__SSc-prME(F108S)
  source 1..2031: mol_type = other RNA
atgagcgccggcatgatcattatgctgatccccaccgtgatggctttccacctcacaacgagaaatggggagcctcatatgattgtctcccggcaggaaaagggaaaatctctgctttttaagaccgaggacggcgttaatatgtgcacactgatggccatggatctcggggaactgtgtgaggacaccatcacatacaaatgcccgcttctgcgccaaaacgaacccgaggatattgactgttggtgcaatagcacctccacatgggtgacctatggaacgtgtaccacaatgggcgagcacagacgggaaaagcgctctgtggcgctcgtccctcatgtggggatgggactggagaccagaacagaaacctggatgagctccgagggcgcttggaaacacgttcagcggatcgagacgtggatcctgcgccatcccggcttcacaatgatggccgccattctcgcttacaccatcgggacaacccactttcagagagccctgattttcatccttctgaccgctgtgacaccttctatgacgatgcggtgcattggaatgagcaaccgcgattttgtcgaaggcgtgtccgggggaagctgggttgacatcgtgctcgagcacggctcttgtgtcaccacaatggccaagaataagcccaccctggatttcgaacttattaaaacagaggcgaagcagcctgccaccctgagaaaatattgcatcgaagctaagctcacgaacacaaccaccgagtcccggtgtccgacacaaggggagcccagcctgaatgaggaacaggacaaacgctttgtgtgcaagcattctatggtggatagaggatggggcaacggctgtgggctgtccggaaagggcgggatcgttacctgcgccatgttccggtgcaaaaagaatatggaaggaaaagtcgtgcagcctgagaacctcgaatacacaattgtgatcacgccccacagcggcgaggagcatgctgtcgggaatgacaccggaaagcacggcaaagaaattaagatcacacctcagtcttccattaccgaggccgaactgacaggctatgggaccgtgacgatggagtgtagcccccgcaccggacttgattttaacgaaatggttctgctccaaatggagaataaagcgtggctggtgcacagacagtggttccttgacctgccgctcccttggctgcccggcgccgatacacaggggtccaactggatccagaaggagaccctggtcacatttaagaatcctcatgctaaaaagcaagacgtggttgtgctcggatctcaggaaggcgccatgcacaccgctctgacgggggccacagagatccagatgagctccggcaaccttctgttcaccggacatctcaaatgccggctgagaatggacaagctgcaactgaaaggcatgagctactctatgtgtacagggaagtttaaggtcgtgaaagaaattgccgagacccagcacggaaccatcgtcattcgcgtgcagtatgagggcgatgggtccccctgcaagatccccttcgaaattatggacctcgagaaacggcatgttctgggaagactgatcacagtgaaccctatcgtcacggaaaaggatagcccggtgaatattgaggctgaaccccctttcggcgactcttacatcattatcggggttgagcccggccagctcaaactgaactggtttaagaagggaagctccattggccaaatgttcgagaccacaatgcgcggggcgaaacggatggccatccttggagataccgcttgggactttggctctcttgggggagtgttcacaagcattggcaaggccctccaccaggtctttggggccatctacggcgctgccttctccggagtgagctggaccatgaaaatcctgattggcgtgatcattacgtggatcgggatgaactctagatccacaagcctgtctgttacccttgtcctcgtgggaattgtgaccctgtatctgggcgtcatggtgcaggcgtga

SEQ ID NO: 2077 - RNA, 2031 nt, synthetic construct
  misc_feature 1..2031: note = derived and/or modified CDS sequence (opt5) from DENV-2 CYD2-T__SSc-prMEdelstem_TM-JEV
  source 1..2031: mol_type = other RNA
atgagcgccggcatgatcattatgctgatccccaccgtgatggctttccacctcacaacgagaaacggggagcctcatatgattgtctcccggcaggaaaagggaaaatctctgctttttaagaccgaggacggcgttaatatgtgcacactgatggccatggatctcggggaactgtgtgaggacaccatcacatacaaatgcccgcttctgcgccaaaacgaacccgaggatattgactgttggtgcaatagcacctccacatgggtgacctatggaacgtgtaccacaatgggcgagcacagacgggaaaagcgctctgtggcgctcgtccctcatgtggggatgggactggagaccagaacagaaacctggatgagctccgagggcgcttggaaacacgttcagcggatcgagacgtggatcctgcgccatcccggcttcacaatgatggccgccattctcgcttacaccatcgggacaacccactttcagagagccctgattttcatccttctgaccgctgtgacaccttctatgacgatgcggtgcattggaatgagcaaccgcgattttgtcgaaggcgtgtccgggggaagctgggttgacatcgtgctcgagcacggctcttgtgtcaccacaatggccaagaataagcccaccctggatttcgaacttattaaaacagaggcgaagcagcctgccaccctgagaaaatattgcatcgaagctaagctcacgaacacaaccaccgagtcccggtgtccgacacaaggggagcccagcctgaatgaggaacaggacaaacgctttgtgtgcaagcattctatggtggatagaggatggggcaacggctgtgggctgttcggaaagggcgggatcgttacctgcgccatgtttcggtgcaaaaagaatatggaaggaaaagtcgtgcagcctgagaacctcgaatacacaattgtgatcacgccccactccggcgaggagcatgctgtcgggaatgacaccggaaagcacggcaaagaaattaagatcacacctcagagctctattaccgaggccgaactgacaggctatgggaccgtgacgatggagtgtagcccccgcaccggacttgatttcaacgaaatggttctgctccaaatggagaataaagcgtggctggtgcacagacagtggtttcttgacctgccgctcccttggctgcccggcgccgatacacaggggtccaactggatccagaaggagaccctggtcacattcaagaatcctcatgctaaaaagcaagacgtggttgtgctcggatcccaggaaggcgccatgcacaccgctctgacgggggccacagagatccagatgtctagcggcaaccttctgtttaccggacatctcaaatgccggctgagaatggacaaacttcaactgaagggcatgtcctacagcatgtgtacagggaagttcaaggtcgtgaaagaaattgccgagacccagcacggaaccatcgtcattcgcgtgcagtatgagggcgatgggtctccctgcaagatccccttcgaaattatggacctcgagaaacggcatgttctgggaagactgatcacagtgaaccctatcgtcacggaaaaggattccccggtgaatattgaggctgaacccccttttggcgacagctacatcattatcggggttgagcccggccagctcaaactgaactggttcaagaagggatctacccttggcaaagcgtttagcacaaccctgaagggggcccaacgcctcgctgccctgggagatacagcctgggacttcggctccattgggggagtgtttaattctatcggccgggctgtccaccaggtgttcgggggcgcctttagaaccctgttcggaggcatgagctggattacgcaggggcttatgggagcgctcctgctgtggatgggcgtgaacgctcgcgatcggtccatcgccctcgcctttctggctacagggggagttcttgtcttcctggccaccaatgtgcacgcttga

SEQ ID NO: 2078 - RNA, 1332 nt, synthetic construct
  misc_feature 1..1332: note = derived and/or modified CDS sequence (opt5) from DENV-2 CYD2-T__SSm-EdelTM
  source 1..1332: mol_type = other RNA
atgttccagagagccctgatctttattctcctgaccgctgtgacacccagcatgacgatgcggtgcatcggcatgtccaaccgcgacttcgtcgagggggtttctggaggcagctgggtggatattgtgcttgaacacgggtcctgtgtcaccacaatggccaagaataaacctaccctggactttgagctcatcaagacagaagcgaaacaaccggctaccctgagaaagtactgcattgaggccaaacttacaaacaccacgaccgaatctcggtgtcccacacagggagagcctagcctgaatgaggaacaggataagcgcttcgtgtgcaagcattccatggttgacagaggctgggggaacggatgtggcctctttggcaaagggggaatcgtgacctgcgccatgttccggtgtaagaaaaatatggagggcaaggtcgtgcagcccgaaaacctggagtatacaatcgttattacccctcactctggggaggaacatgctgtgggaaatgatacgggcaaacacgggaaggagatcaagattacaccccaaagctccatcaccgaagccgagctgacaggatacggcaccgtcaccatggaatgcagccctcgcacaggcctcgactttaacgagatggtgctgcttcagatggagaataaggcttggctggtgcatagacagtggttcctcgatctgccgcttccctggctgcctggggccgacacgcagggatctaactggattcaaaaagaaaccctcgtcacatttaaaaatccccacgcgaagaaacaggatgttgtggtgctgggctcccaggagggggccatgcacaccgctctgacaggagccaccgaaatccagatgagctctggcaacctcctgttcacggggcatcttaagtgtcggctgcgcatggacaaactccaactgaagggaatgtcctatagcatgtgcacaggcaagtttaaagtcgtgaaggagattgctgaaacccagcacggcaccatcgttatcagagtgcagtacgagggggatggatctccttgtaaaattcccttcgagatcatggaccttgaaaagcggcatgtcctgggccgcctcattacagtgaatccgatcgttaccgagaaagattcccctgtgaacattgaagccgagcccccttttggggacagctatatcatcattggagtcgaacccggccaactgaagctgaattggttcaagaaagggtcctctatcggccagatgttcgagacaacgatgagaggagcgaagcggatggccattctcggcgacaccgcttgggattttgggagctga

SEQ ID NO: 2079 - RNA, 2379 nt, synthetic construct
  misc_feature 1..2379: note = derived and/or modified CDS sequence (opt5) from DENV-2 CYD2-T__C-P2A-SSc-prME
  source 1..2379: mol_type = other RNA
atgaacaatcagagaaagaaagccaagaacacccccttcaatatgctgaaacgggagcgcaacagagtgagcacagtccaacagctcacgaagcggttttccctgggcatgcttcaggggcgcggacctctgaaactcttcatggctctggttgcctttcttagattcctgaccatcccgcccacagcgggcattctcaagcggtgggggaccatcaagaaatctaaggctattaatgtgctgcgcggatttagaaaagaaatcggccggatgctgaacattctcaatcgcagacggcgcaacttcgacctgcttaagctggccggggatgtggagagcaatcctggaccctccgccggcatgatcatcatgctcattcctacagtcatggcttttcacctgaccacaagaaacggcgaaccccatatgatcgtgtctcggcaggagaaagggaagtctcttctgttcaagaccgaagacggagttaatatgtgcacgctcatggccatggatctgggcgagctgtgtgaggacaccattacatacaaatgccctctcctgcgccaaaacgaaccggaggatatcgactgttggtgcaattccacctctacatgggtgacctatgggacgtgtacaaccatgggagaacacagacgggagaagagaagcgtcgctcttgtgccccatgttggcatggggctggagacacgcaccgaaacctggatgtccagcgagggagcctggaaacacgtgcagcggattgaaacatggatcctcagacatcctggctttacgatgatggcggccattctggcttacaccatcggcacaacccacttccagcgcgcccttatctttattctgctcacagctgtcaccccctctatgacgatgcggtgcatcgggatgtccaacagagatttcgtggagggagtgagcggcgggtcttgggtcgacattgttctggaacacggatcctgtgtgacaaccatggccaagaataaacctaccctggattttgagctcatcaagacagaggcgaaacagcccgccaccctgcgcaagtattgcattgaagctaaacttacaaacacgaccacagagagccggtgtccgacccaaggcgaaccttctctgaacgaggaacaggacaagagattcgtgtgcaagcattccatggtcgatcgcgggtggggaaatggctgtggcctcttcgggaaaggaggcatcgtgacatgcgccatgtttcggtgcaagaaaaacatggaggggaaggttgtgcagcccgagaatctggaatacaccatcgtcattacgcctcacagcggagaggaacatgctgtgggcaacgacaccgggaagcacggcaaagagatcaagattacaccccagtcctctatcaccgaagccgagcttacaggatatggcaccgttacgatggagtgtagccccagaacagggctggatttcaatgaaatggtgctcctgcaaatggagaacaaagcctggctggtccaccgccagtggtttctcgacctgcctcttccgtggctgcccggagctgacacccagggctccaattggattcaaaaggaaacactcgtgaccttcaaaaaccctcatgcgaagaagcaggatgtcgtggttctggggagccaggagggagccatgcacaccgctctgacaggcgccacggagatccagatgtcttccgggaatcttctctttaccggccatctgaaatgccggctgagaatggacaagctccaactgaaaggaatgagctactctatgtgtacaggcaagttcaaagtggtcaaggaaatcgccgagacccagcacgggacaattgtgatccgggttcagtatgaaggagatggcagcccctgcaagattccttttgagatcatggaccttgaaaaacgccatgtgctggggagactcattaccgtcaaccccatcgtgacggagaaggattccccggtgaatattgaggctgaacctcccttcggagactcttacatcatcattggcgttgagcctgggcagctgaaactgaactggtttaagaaaggcagctccatcggacaaatgttcgaaacaaccatgcggggcgccaagagaatggcgattcttggggataccgcttgggactttggaagcctcggcggggtcttcacatctatcggaaaagccctgcaccaggtgtttggcgccatttacggggctgccttctccggcgtgagctggaccatgaagatcctgatcggagtcattatcacatggattggcatgaatagccgctccacgagcctctccgtgaccctggttcttgtggggatcgtcacactgtatctcggagtgatggttcaggcttga

SEQ ID NO: 2080 - RNA, 2043 nt, synthetic construct
  misc_feature 1..2043: note = derived and/or modified CDS sequence (opt5) from DENV-2 CYD2-T__SSopt-prME(F108S)
  source 1..2043: mol_type = other RNA
atgaagcggaaaaagagcgccggcatgatcattatgctgatccccaccgtgatggctttccacctcacaacgcggaatggggagcctcatatgattgtctcccgccaggaaaaaggaaagtctctgctttttaaaaccgaggacggcgttaatatgtgcacactgatggccatggatctcggggaactgtgtgaggacaccatcacatacaagtgcccgcttctgagacaaaacgaacccgaggatattgactgttggtgcaatagcacctccacatgggtgacctatggaacgtgtaccacaatgggcgagcaccggcgcgaaaagagatctgtggcgctcgtccctcatgtggggatgggactggagacccggacagaaacctggatgagctccgagggcgcttggaaacacgttcagcgcatcgagacgtggatcctgagacatcccggcttcacaatgatggccgccattctcgcttacaccatcgggacaacccactttcagcgggccctgattttcatccttctgaccgctgtgacaccttctatgacgatgcgctgcattggaatgagcaacagagattttgtcgaaggcgtgtccgggggaagctgggttgacatcgtgctcgagcacggctcttgtgtcaccacaatggccaagaataaacccaccctggatttcgaacttattaagacagaggcgaaacagcctgccaccctgcggaagtattgcatcgaagctaagctcacgaacacaaccaccgagtcccgctgtccgacacaaggggagcccagcctgaatgaggaacaggacaaaagatttgtgtgcaagcattctatggtggatcggggatggggcaacggctgtgggctgtccggaaaaggcgggatcgttacctgcgccatgttccgctgcaagaaaaatatggaaggaaaggtcgtgcagcctgagaacctcgaatacacaattgtgatcacgccccacagcggcgaggagcatgctgtcgggaatgacaccggaaaacacggcaaggaaattaagatcacacctcagtcttccattaccgaggccgaactgacaggctatgggaccgtgacgatggagtgtagccccagaaccggacttgattttaacgaaatggttctgctccaaatggagaataaagcgtggctggtgcaccggcagtggttccttgacctgccgctcccttggctgcccggcgccgatacacaggggtccaactggatccagaaggagaccctggtcacatttaaaaatcctcatgctaagaaacaagacgtggttgtgctcggatctcaggaaggcgccatgcacaccgctctgacgggggccacagagatccagatgagctccggcaaccttctgttcaccggacatctcaagtgcagactgcgcatggacaagctgcaactgaaaggcatgagctactctatgtgtacagggaagtttaaagtcgtgaaggaaattgccgagacccagcacggaaccatcgtcattcgggtgcagtatgagggcgatgggtccccctgcaaaatccccttcgaaattatggacctcgagaagagacatgttctgggacgcctgatcacagtgaaccctatcgtcacggaaaaggatagcccggtgaatattgaggctgaaccccctttcggcgactcttacatcattatcggggttgagcccggccagctcaaactgaactggtttaagaaaggaagctccattggccaaatgttcgagaccacaatgagaggggcgaagagaatggccatccttggagataccgcttgggactttggctctcttgggggagtgttcacaagcattggcaaagccctccaccaggtctttggggccatctacggcgctgccttctccggagtgagctggaccatgaagatcctgattggcgtgatcattacgtggatcgggatgaactctcgctccacaagcctgtctgttacccttgtcctcgtgggaattgtgaccctgtatctgggcgtcatggtgcaggcgtga

SEQ ID NO: 2081 - RNA, 2043 nt, synthetic construct
  misc_feature 1..2043: note = derived and/or modified CDS sequence (opt5) from DENV-2 CYD2-T__SSopt-prME(M96H)
  source 1..2043: mol_type = other RNA
atgaagcggaaaaagagcgccggcatgatcattatgctgatccccaccgtgatggctttccacctcacaacgcggaacggggagcctcatatgattgtctcccgccaggaaaaaggaaagtctctgctttttaaaaccgaggacggcgttaatatgtgcacactgatggccatggatctcggggaactgtgtgaggacaccatcacatacaagtgcccgcttctgagacaaaacgaacccgaggatattgactgttggtgcaatagcacctccacatgggtgacctatggaacgtgtaccacaatgggcgagcaccggcgcgaaaagagatctgtggcgctcgtccctcatgtggggatgggactggagacccggacagaaacctggatgagctccgagggcgcttggaaacacgttcagcgcatcgagacgtggatcctgagacatcccggcttcacaatgatggccgccattctcgcttacaccatcgggacaacccactttcagcgggccctgattttcatccttctgaccgctgtgacaccttctatgacgatgcgctgcattggaatgagcaacagagattttgtcgaaggcgtgtccgggggaagctgggttgacatcgtgctcgagcacggctcttgtgtcaccacaatggccaagaataaacccaccctggatttcgaacttattaagacagaggcgaaacagcctgccaccctgcggaagtattgcatcgaagctaagctcacgaacacaaccaccgagtcccgctgtccgacacaaggggagcccagcctgaatgaggaacaggacaaaagatttgtgtgcaagcattctcacgtggatcggggatggggcaacggctgtgggctgttcggaaaaggcgggatcgttacctgcgccatgtttcgctgcaagaaaaatatggaaggaaaggtcgtgcagcctgagaacctcgaatacacaattgtgatcacgccccattccggcgaggagcacgctgtcgggaatgacaccggaaaacacggcaaggaaattaagatcacacctcagagctctattaccgaggccgaactgacaggctatgggaccgtgacgatggagtgttcccccagaaccggacttgatttcaacgaaatggttctgctccaaatggagaataaagcgtggctggtgcatcggcagtggtttcttgacctgccgctcccttggctgcccggcgccgatacacaggggagcaactggatccagaaggagaccctggtcacattcaaaaatcctcacgctaagaaacaagacgtggttgtgctcggatcccaggaaggcgccatgcataccgctctgacgggggccacagagatccagatgtctagcggcaaccttctgtttaccggacacctcaagtgcagactgcgcatggacaagctgcaactgaaaggcatgtcctacagcatgtgtacagggaagttcaaagtcgtgaaggaaattgccgagacccagcatggaaccatcgtcattcgggtgcagtatgagggcgatgggtctccctgcaaaatccccttcgaaattatggacctcgagaagagacacgttctgggacgcctgatcacagtgaaccctatcgtcacggaaaaggattccccggtgaatattgaggctgaacccccttttggcgacagctacatcattatcggggttgagcccggccagctcaaactgaactggttcaagaaaggatctagcattggccaaatgtttgagaccacaatgagaggggcgaagagaatggccatccttggagataccgcttgggacttcggctcccttgggggagtgtttacatctattggcaaagccctccaccaggtcttcggggccatctacggcgctgcctttagcggagtgtcctggaccatgaagatcctgattggcgtgatcattacgtggatcgggatgaatagccgctctacatccctgagcgttacccttgtcctcgtgggaattgtgaccctgtatctgggcgtcatggtgcaggcgtga

SEQ ID NO: 2082 - RNA, 2043 nt, synthetic construct
  misc_feature 1..2043: note = derived and/or modified CDS sequence (opt5) from DENV-2 CYD2-T__SSopt-prME(S186F)
  source 1..2043: mol_type = other RNA
atgaagcggaaaaagagcgccggcatgatcattatgctgatccccaccgtgatggctttccacctcacaacgcggaatggggagcctcatatgattgtctcccgccaggaaaaaggaaagtctctgctttttaaaaccgaggacggcgttaatatgtgcacactgatggccatggatctcggggaactgtgtgaggacaccatcacatacaagtgcccgcttctgagacaaaacgaacccgaggatattgactgttggtgcaatagcacctccacatgggtgacctatggaacgtgtaccacaatgggcgagcaccggcgcgaaaagagatctgtggcgctcgtccctcatgtggggatgggactggagacccggacagaaacctggatgagctccgagggcgcttggaaacacgttcagcgcatcgagacgtggatcctgagacatcccggcttcacaatgatggccgccattctcgcttacaccatcgggacaacccactttcagcgggccctgattttcatccttctgaccgctgtgacaccttctatgacgatgcgctgcattggaatgagcaacagagattttgtcgaaggcgtgtccgggggaagctgggttgacatcgtgctcgagcacggctcttgtgtcaccacaatggccaagaataaacccaccctggatttcgaacttattaagacagaggcgaaacagcctgccaccctgcggaagtattgcatcgaagctaagctcacgaacacaaccaccgagtcccgctgtccgacacaaggggagcccagcctgaatgaggaacaggacaaaagatttgtgtgcaagcattctatggtggatcggggatggggcaacggctgtgggctgttcggaaaaggcgggatcgttacctgcgccatgtttcgctgcaagaaaaatatggaaggaaaggtcgtgcagcctgagaacctcgaatacacaattgtgatcacgccccactccggcgaggagcatgctgtcgggaatgacaccggaaaacacggcaaggaaattaagatcacacctcagagctctattaccgaggccgaactgacaggctatgggaccgtgacgatggagtgtttccccagaaccggacttgattttaacgaaatggttctgctccaaatggagaataaagcgtggctggtgcaccggcagtggttccttgacctgccgctcccttggctgcccggcgccgatacacaggggtccaactggatccagaaggagaccctggtcacatttaaaaatcctcatgctaagaaacaagacgtggttgtgctcggaagccaggaaggcgccatgcacaccgctctgacgggggccacagagatccagatgtcctctggcaaccttctgttcaccggacatctcaagtgcagactgcgcatggacaagctgcaactgaaaggcatgagctactccatgtgtacagggaagttcaaagtcgtgaaggaaattgccgagacccagcacggaaccatcgtcattcgggtgcagtatgagggcgatgggagcccctgcaaaatcccctttgaaattatggacctcgagaagagacatgttctgggacgcctgatcacagtgaaccctatcgtcacggaaaaggattctccggtgaatattgaggctgaaccccctttcggcgactcctacatcattatcggggttgagcccggccagctcaaactgaactggtttaagaaaggaagctctattggccaaatgttcgagaccacaatgagaggggcgaagagaatggccatccttggagataccgcttgggactttggcagccttgggggagtgttcacatccattggcaaagccctccaccaggtctttggggccatctacggcgctgccttctctggagtgagctggaccatgaagatcctgattggcgtgatcattacgtggatcgggatgaactcccgcagcacatctctgtccgttacccttgtcctcgtgggaattgtgaccctgtatctgggcgtcatggtgcaggcgtga

SEQ ID NO: 2083 - RNA, 2043 nt, synthetic construct
  misc_feature 1..2043: note = derived and/or modified CDS sequence (opt5) from DENV-2 CYD2-T__SSopt-prME(R188L)
  source 1..2043: mol_type = other RNA
atgaagcggaaaaagagcgccggcatgatcattatgctgatccccaccgtgatggctttccacctcacaacgagaaacggggagcctcatatgattgtctcccgccaggaaaaaggaaagtctctgctttttaaaaccgaggacggcgttaatatgtgcacactgatggccatggatctcggggaactgtgtgaggacaccatcacatacaagtgcccgcttctgagacaaaacgaacccgaggatattgactgttggtgcaatagcacctccacatgggtgacctatggaacgtgtaccacaatgggcgagcaccggcgcgaaaagagatctgtggcgctcgtccctcatgtggggatgggactggagacccggacagaaacctggatgagctccgagggcgcttggaaacacgttcagcgcatcgagacgtggatcctgagacatcccggcttcacaatgatggccgccattctcgcttacaccatcgggacaacccactttcagcgggccctgattttcatccttctgaccgctgtgacaccttctatgacgatgcgctgcattggaatgagcaacagagattttgtcgaaggcgtgtccgggggaagctgggttgacatcgtgctcgagcacggctcttgtgtcaccacaatggccaagaataaacccaccctggatttcgaacttattaagacagaggcgaaacagcctgccaccctgcggaagtattgcatcgaagctaagctcacgaacacaaccaccgagtcccgctgtccgacacaaggggagcccagcctgaatgaggaacaggacaaaagatttgtgtgcaagcattctatggtggatcggggatggggcaacggctgtgggctgttcggaaaaggcgggatcgttacctgcgccatgtttcgctgcaagaaaaatatggaaggaaaggtcgtgcagcctgagaacctcgaatacacaattgtgatcacgccccactccggcgaggagcatgctgtcgggaatgacaccggaaaacacggcaaggaaattaagatcacacctcagagctctattaccgaggccgaactgacaggctatgggaccgtgacgatggagtgtagcccccttaccggactggatttcaacgaaatggttctcctgcaaatggagaataaagcgtggcttgtgcacagacagtggtttctggacctcccgctgccttggctgcccggcgccgatacacaggggtccaactggatccagaaggagaccctcgtcacattcaaaaatcctcatgctaagaaacaagacgtggttgtgctgggatcccaggaaggcgccatgcacaccgctcttacgggggccacagagatccagatgtctagcggcaacctgctctttaccggacatctgaagtgccggcttagaatggacaagctgcaactcaaaggcatgtcctacagcatgtgtacagggaagttcaaagtcgtgaaggaaattgccgagacccagcacggaaccatcgtcattcgcgtgcagtatgagggcgatgggtctccctgcaaaatccccttcgaaattatggacctggagaagcggcatgttctgggaagactcatcacagtgaaccctatcgtcacggaaaaggattccccggtgaatattgaggctgaacccccttttggcgacagctacatcattatcggggttgagcccggccagctgaaacttaactggttcaagaaaggatctagcattggccaaatgtttgagaccacaatgcgcggggcgaagcggatggccatcctgggagataccgcttgggacttcggctccctcgggggagtgtttacatctattggcaaagccctgcaccaggtcttcggggccatctacggcgctgcctttagcggagtgtcctggaccatgaagatcctgattggcgtgatcattacgtggatcgggatgaatagcagatctacatcccttagcgttaccctcgtcctggtgggaattgtgaccctgtatctcggcgtcatggtgcaggcgtga

SEQ ID NO: 2084 - RNA, 2043 nt, synthetic construct
  misc_feature 1..2043: note = derived and/or modified CDS sequence (opt5) from DENV-2 CYD2-T__SSopt-pr(D104A)MEdelstem_TM,(F108S)-JEV
  source 1..2043: mol_type = other RNA
atgaagcggaaaaagagcgccggcatgatcattatgctgatccccaccgtgatggctttccacctcacaacgagaaacggggagcctcatatgattgtctcccgccaggaaaaaggaaagtctctgctttttaaaaccgaggacggcgttaatatgtgcacactgatggccatggatctcggggaactgtgtgaggacaccatcacatacaagtgcccgcttctgagacaaaacgaacccgaggatattgactgttggtgcaatagcacctccacatgggtgacctatggaacgtgtaccacaatgggcgagcaccggcgcgcgaagagatctgtggctctcgtccctcatgtggggatgggactggaaacccggacagagacctggatgagctccgaaggcgcctggaaacacgttcagcgcatcgagacgtggatcctgagacatcccggcttcacaatgatggccgctattctcgcctacaccatcgggacaacccactttcagcgggctctgattttcatccttctgaccgccgtgacaccttctatgacgatgcgctgcattggaatgagcaacagagattttgtcgagggcgtgtccgggggaagctgggttgacatcgtgctcgaacacggctcttgtgtcaccacaatggcgaagaataaacccaccctggatttcgagcttattaagacagaagccaaacagcctgctaccctgcggaagtattgcatcgaggccaagctcacgaacacaaccaccgaatcccgctgtccgacacaaggggagcccagcctgaatgaggaacaggacaaaagatttgtgtgcaagcattctatggtggatcggggatggggcaacggctgtgggctgtccggaaaaggcgggatcgttacctgcgctatgttccgctgcaagaaaaatatggagggaaaggtcgtgcagcctgaaaacctcgagtacacaattgtgatcacgccccacagcggcgaggaacatgccgtcgggaatgacaccggaaaacacggcaaggagattaagatcacacctcagtcttccattaccgaagcggagctgacaggctatgggaccgtgacgatggaatgtagccccagaaccggacttgattttaacgagatggttctgctccaaatggaaaataaagcctggctggtgcaccggcagtggttccttgacctgccgctcccttggctgcccggcgctgatacacaggggtccaactggatccagaaggagaccctggtcacatttaaaaatcctcatgccaagaaacaagacgtggttgtgctcggatctcaggagggcgctatgcacaccgccctgacgggggccacagaaatccagatgagctccggcaaccttctgttcaccggacatctcaagtgcagactgcgcatggacaaacttcaactgaagggcatgagctactctatgtgtacagggaagtttaaagtcgtgaaggagattgctgaaacccagcacggaaccatcgtcattcgggtgcagtatgagggcgatgggtccccctgcaaaatccccttcgagattatggacctcgaaaagagacatgttctgggacgcctgatcacagtgaaccctatcgtcacggagaaggatagcccggtgaatattgaagcggagccccctttcggcgactcttacatcattatcggggttgaacccggccagctcaaactgaactggtttaagaaaggaagcacccttggcaaggccttctccacaaccctgaaaggggctcaacggctcgccgccctgggagatacagcttgggactttggctctattgggggagtgttcaatagcatcggcagagccgtccaccaggtgtttgggggcgcgttccgcaccctgtttggaggcatgtcctggattacgcaggggcttatgggagctctcctgctgtggatgggcgtgaacgcccgggatagaagcatcgccctcgctttcctggccacagggggagttcttgtctttctggctaccaatgtgcacgcctga

SEQ ID NO: 2085 - RNA, 2043 nt, synthetic construct
  misc_feature 1..2043: note = derived and/or modified CDS sequence (opt5) from DENV-2 CYD2-T__SSopt-prMEdelstem_TM,(H261N)-JEV
  source 1..2043: mol_type = other RNA
atgaagcggaaaaagagcgccggcatgatcattatgctgatccccaccgtgatggctttccacctcacaacgagaaacggggagcctcatatgattgtctcccgccaggaaaaaggaaagtctctgctttttaaaaccgaggacggcgttaatatgtgcacactgatggccatggatctcggggaactgtgtgaggacaccatcacatacaagtgcccgcttctgagacaaaacgaacccgaggatattgactgttggtgcaatagcacctccacatgggtgacctatggaacgtgtaccacaatgggcgagcaccggcgcgaaaagagatctgtggcgctcgtccctcatgtggggatgggactggagacccggacagaaacctggatgagctccgagggcgcttggaaacacgttcagcgcatcgagacgtggatcctgagacatcccggcttcacaatgatggccgccattctcgcttacaccatcgggacaacccactttcagcgggccctgattttcatccttctgaccgctgtgacaccttctatgacgatgcgctgcattggaatgagcaacagagattttgtcgaaggcgtgtccgggggaagctgggttgacatcgtgctcgagcacggctcttgtgtcaccacaatggccaagaataaacccaccctggatttcgaacttattaagacagaggcgaaacagcctgccaccctgcggaagtattgcatcgaagctaagctcacgaacacaaccaccgagtcccgctgtccgacacaaggggagcccagcctgaatgaggaacaggacaaaagatttgtgtgcaagcattctatggtggatcggggatggggcaacggctgtgggctgttcggaaaaggcgggatcgttacctgcgccatgtttcgctgcaagaaaaatatggaaggaaaggtcgtgcagcctgagaacctcgaatacacaattgtgatcacgccccactccggcgaggagcatgctgtcgggaatgacaccggaaaacacggcaaggaaattaagatcacacctcagagctctattaccgaggccgaactgacaggctatgggaccgtgacgatggagtgttcccccagaaccggacttgatttcaacgaaatggttctgctccaaatggagaataaagcgtggctggtgcaccggcagtggtttcttgacctgccgctcccttggctgcccggcgccgatacacaggggagcaactggatccagaaggagaccctggtcacattcaaaaatcctcatgctaagaaacaagacgtggttgtgctcggatcccaggaaggcgccatgaacaccgctctgacgggggccacagagatccagatgtctagcggcaaccttctgtttaccggacacctcaagtgcagactgcgcatggacaaacttcaactgaagggcatgtcctacagcatgtgtacagggaagttcaaagtcgtgaaggaaattgccgagacccagcatggaaccatcgtcattcgggtgcagtatgagggcgatgggtctccctgcaaaatccccttcgaaattatggacctcgagaagagacacgttctgggacgcctgatcacagtgaatcctatcgtcacggaaaaggattccccggtgaacattgaggctgaacccccttttggcgacagctacatcattatcggggttgagcccggccagctcaaactgaattggttcaagaaaggatctacccttggcaaggcgtttagcacaaccctgaaaggggcccaacggctcgctgccctgggagatacagcctgggacttcggctccattgggggagtgtttaactctatcggcagagctgtccatcaggtgttcgggggcgcctttcgcaccctgttcggaggcatgagctggattacgcaggggcttatgggagcgctcctgctgtggatgggcgtgaatgctcgggatagatccatcgccctcgcctttctggctacagggggagttcttgtcttcctggccaccaacgtgcacgcttga

SEQ ID NO: 2086 - RNA, 2043 nt, synthetic construct
  misc_feature 1..2043: note = derived and/or modified CDS sequence (opt5) from DENV-2 CYD2-T__SSopt-prMEdelstem_TM,(R188L,A267T)-JEV
  source 1..2043: mol_type = other RNA
atgaagcggaaaaagagcgccggcatgatcattatgctgatccccaccgtgatggctttccacctcacaacgagaaacggggagcctcatatgattgtctcccgccaggaaaaaggaaagtctctgctttttaaaaccgaggacggcgttaatatgtgcacactgatggccatggatctcggggaactgtgtgaggacaccatcacatacaagtgcccgcttctgagacaaaacgaacccgaggatattgactgttggtgcaatagcacctccacatgggtgacctatggaacgtgtaccacaatgggcgagcaccggcgcgaaaagagatctgtggcgctcgtccctcatgtggggatgggactggagacccggacagaaacctggatgagctccgagggcgcttggaaacacgttcagcgcatcgagacgtggatcctgagacatcccggcttcacaatgatggccgccattctcgcttacaccatcgggacaacccactttcagcgggccctgattttcatccttctgaccgctgtgacaccttctatgacgatgcgctgcattggaatgagcaacagagattttgtcgaaggcgtgtccgggggaagctgggttgacatcgtgctcgagcacggctcttgtgtcaccacaatggccaagaataaacccaccctggatttcgaacttattaagacagaggcgaaacagcctgccaccctgcggaagtattgcatcgaagctaagctcacgaacacaaccaccgagtcccgctgtccgacacaaggggagcccagcctgaatgaggaacaggacaaaagatttgtgtgcaagcattctatggtggatcggggatggggcaacggctgtgggctgttcggaaaaggcgggatcgttacctgcgccatgtttcgctgcaagaaaaatatggaaggaaaggtcgtgcagcctgagaacctcgaatacacaattgtgatcacgccccactccggcgaggagcatgctgtcgggaatgacaccggaaaacacggcaaggaaattaagatcacacctcagagctctattaccgaggccgaactgacaggctatgggaccgtgacgatggagtgtagcccccttaccggactggatttcaacgaaatggttctcctgcaaatggagaataaagcgtggcttgtgcacagacagtggtttctggacctcccgctgccttggctgcccggcgccgatacacaggggtccaactggatccagaaggagaccctcgtcacattcaaaaatcctcatgctaagaaacaagacgtggttgtgctgggatcccaggaaggcgccatgcacaccgctcttacggggacaaccgagatccagatgtctagcggcaacctgctctttacaggacatctgaagtgccggcttagaatggacaagctgcaactcaaaggcatgtcctacagcatgtgtaccgggaagttcaaagtcgtgaaggaaattgccgagacccagcacggaacaatcgtcattcgcgtgcagtatgagggcgatgggtctccctgcaaaatccccttcgaaattatggacctggagaagcggcatgttctgggaagactcatcacggtgaaccctatcgtcaccgaaaaggattccccggtgaatattgaggccgaacccccttttggcgacagctacatcattatcggggttgagcccggccagctgaaacttaactggttcaagaaaggatctacactgggcaaggcttttagcaccacactcaaaggggcgcaacgcctggccgctctgggagataccgcctgggacttcggctccattgggggagtgtttaattctatcggccgggccgtccaccaggtgttcgggggcgcttttagaacgcttttcggaggcatgagctggattacacaggggctcatgggagccctgctgctctggatgggcgtgaacgcgcgcgatcggtccatcgctctggcctttcttgccaccgggggagttctggtcttcctcgctaccaatgtgcacgcctga

SEQ ID NO: 2087 - RNA, 297 nt, synthetic construct
  misc_feature 1..297: note = derived and/or modified CDS sequence (opt5) from DENV-4 Consensus__C
  source 1..297: mol_type = other RNA
atgaaccagagaaagaaagtggtccggccccctttcaatatgctgaagcgcgagagaaaccgggttagcaccccgcaaggcctcgtgaaacgcttttccacagggctgttctctggaaagggcccccttagaatggtgctggcctttatcacgttcctccgggtcctgagcattcctcccaccgctgggatccttaaacgctggggacagctgaagaagaataaagccattaagatcctcattggctttagaaaagaaatcgggcggatgctgaacatcctgaatggacgcaagaga

SEQ ID NO: 2088 - RNA, 339 nt, synthetic construct
  misc_feature 1..339: note = derived and/or modified CDS sequence (opt5) from DENV-4 Consensus__C-SSc
  source 1..339: mol_type = other RNA
atgaaccagagaaagaaagtggtccggccccctttcaatatgctgaagcgcgagagaaaccgggttagcaccccgcaaggcctcgtgaaacgcttttccacagggctgttctctggaaagggcccccttagaatggtgctggcctttatcacgttcctccgggtcctgagcattcctcccaccgctgggatccttaaacgctggggacagctgaagaagaataaagccattaagatcctcattggctttagaaaagaaatcgggcggatgctgaacatcctgaatggacgcaagagatccacaattaccctcctgtgccttatccctacagtgatggcg

SEQ ID NO: 2089 - RNA, 273 nt, synthetic construct
  misc_feature 1..273: note = derived and/or modified CDS sequence (opt5) from DENV-4 Consensus__pr
  source 1..273: mol_type = other RNA
ttccacctgagcaccagagacggcgagcccctcatgatcgtggccaagcatgaacgggggcgccctctgctttttaaaacaacggagggaattaacaagtgcaccctgatcgctatggatctcggcgaaatgtgtgaggacacagtcacctacaaatgcccgctgcttgttaatacagaacccgaggatattgactgttggtgcaacctgacctccacatgggtgatgtatgggacctgtacgcagtctggagagagacggcgcgaaaagaga

SEQ ID NO: 2090 - RNA, 225 nt, synthetic construct
  misc_feature 1..225: note = derived and/or modified CDS sequence (opt5) from DENV-4 Consensus__M
  source 1..225: mol_type = other RNA
agcgtggccctgacaccccactccggcatggggctcgagaccagagctgaaacgtggatgtctagcgagggagcctggaagcatgcgcagcgggtcgaatcctggatcctgcgcaaccctggcttcgcccttctggctgggtttatggcctacatgattggacaaaccggcatccagagaacagttttctttgtgctcatgatgctggtggctccgtcttatggg

SEQ ID NO: 2091 - RNA, 498 nt, synthetic construct
  misc_feature 1..498: note = derived and/or modified CDS sequence (opt5) from DENV-4 Consensus__prM
  source 1..498: mol_type = other RNA
ttccacctgagcaccagagacggcgagcccctcatgatcgtggccaagcatgaacgggggcgccctctgctttttaaaacaacggagggaattaacaagtgcaccctgatcgctatggatctcggcgaaatgtgtgaggacacagtcacctacaaatgcccgctgcttgttaatacagaacccgaggatattgactgttggtgcaacctgacctccacatgggtgatgtatgggacctgtacgcagtctggagagagacggcgcgaaaagagaagcgtggccctcacccctcactccggcatggggctggagacacgggcggaaacctggatgtctagcgagggagcttggaaacatgcccaacgcgtcgagtcctggatcctgagaaatcccggcttcgccctcctggctggctttatggcctacatgattgggcagacaggaatccagcggaccgtgttctttgttcttatgatgctggtggctccttcttatggc

SEQ ID NO: 2092 - RNA, 1485 nt, synthetic construct
  misc_feature 1..1485: note = derived and/or modified CDS sequence (opt5) from DENV-4 Consensus__E
  source 1..1485: mol_type = other RNA
atgagatgcgtgggcgtcgggaaccgggacttcgttgagggagtgagcggcggggcctgggtggatctggtcctcgaacacggaggctgtgtgaccacaatggctcaggggaagcccacgctggactttgagcttaccaaaacaaccgccaaggaagttgcgctgctccgcacatactgcatcgaggcttccatttctaatatcaccacagccaccagatgtcctacgcaaggagaaccgtatctgaaagaggagcaggatcagcagtacatttgccggcgcgacgtggtcgatagaggctggggcaacgggtgtggacttttcggcaaagggggagtggttacctgcgccaagtttagctgttccggcaagatcacagggaatctggtgcaaattgaaaacctcgagtataccgtcgtggtgacagtccataatggagacacccacgctgttggcaacgatacgtctaatcatggcgtgacagccaccatcacaccccggagcccttccgtggaagtcaagctgcccgactacggggagctgaccctcgattgcgagcctcgctctggaatcgacttcaacgaaatgattctgatgaaaatgaagaaaaagacctggcttgtgcacaaacagtggtttctggatctccccctgccttggacagctggcgccgacacgagcgaggttcattggaattataaggaaagaatggtgaccttcaaggtcccgcacgcgaaacggcaggatgtgacagttcttgggtcccaggagggagccatgcacagcgctctggccggcgctaccgaagtggactctggggacggaaaccatatgtttgccggccacctcaagtgtaaagtccgcatggagaagctgagaatcaaaggcatgtcctacacaatgtgcagcgggaagttctctattgataaagagatggcggaaacccaacatggaacgacagtggtcaaggtgaagtatgagggcgccggggctccctgtaaagttcctatcgaaattcgggacgtgaataaggagaaagtcgtgggacgcgttatctccagcacacccctggccgaaaacaccaattctgtgaccaacattgagctcgagcctccctttggcgattcctacatcgtcatcggggtgggcaatagcgctctgacccttcactggttcagaaagggatcctctattggcaaaatgtttgaaagcacataccgcggggccaagcggatggccatcctgggagagacggcttgggacttcggctccgttgggggactctttaccagcctgggcaaggcggtgcaccaggtcttcgggtctgtgtatacaaccatgttcggcggagtgtcctggatgattagaatccttattggctttctggtcctctggatcgggacaaacagccggaacacctctatggccatgacgtgcatcgctgtgggaggcattaccctgttcctggggtttacagttcaggcc

SEQ ID NO: 2093 - RNA, 1983 nt, synthetic construct
  misc_feature 1..1983: note = derived and/or modified CDS sequence (opt5) from DENV-4 Consensus__prME
  source 1..1983: mol_type = other RNA
ttccacctgagcaccagagacggcgagcccctcatgatcgtggccaagcatgaacgggggcgccctctgctttttaaaacaacggagggaattaacaagtgcaccctgatcgctatggatctcggcgaaatgtgtgaggacacagtcacctacaaatgcccgctgcttgttaatacagaacccgaggatattgactgttggtgcaacctgacctccacatgggtgatgtatgggacctgtacgcagtctggagagagacggcgcgaaaagagaagcgtggccctcacccctcactccggcatggggctggagacacgggcggaaacctggatgtctagcgagggagcttggaaacatgcccaacgcgtcgagtcctggatcctgagaaatcccggcttcgccctcctggctggctttatggcctacatgattgggcagacaggaatccagcggaccgtgttctttgttcttatgatgctggtggctccttcttatggcatgcgctgcgtcggggtgggaaacagagatttcgttgaaggcgtgagcgggggagcctgggtcgacctcgtgctggagcacggcggctgtgtgacgacaatggcgcaggggaagcccacccttgattttgaactgacaaagaccaccgccaaagaggtcgctctcctgcggacatactgcatcgaagcctccattagcaatatcacgaccgctacacgctgtcctacccaaggagagccgtatctgaaggaggaacaggaccagcagtacatttgcagacgggatgttgtggaccgcggctgggggaacggatgtggcctcttcgggaaaggaggcgtggtcacatgcgccaagttttcttgctccggcaaaatcaccgggaatctggtgcaaattgagaaccttgaatatacggttgtggtcacagtgcataatggagatacccacgcggttggcaacgacaccagcaatcacggggtgacagccaccatcacacccagatctccttccgtcgaggtgaagctgcccgattacggagaactcacgctggactgtgagcctcggagcggcattgacttcaacgagatgatccttatgaagatgaaaaagaaaacctggctggtccataagcagtggtttctcgatctgcccctgccgtggacagctggggccgacacctctgaagtgcactggaattacaaagagagaatggttacattcaaggtgcctcatgctaaacgccaggatgtcaccgtgctcggctcccaggaaggagccatgcacagcgccctggctggcgcgacggaggttgactccggggatggaaaccacatgtttgccggccatcttaagtgcaaggtgcggatggaaaaactgagaatcaaggggatgtcttataccatgtgtagcggaaaattctccattgacaaggagatggctgagacacaacacggcaccacagtcgtgaaagtgaagtacgaaggggccggcgccccctgcaaggttcctatcgagattcgcgatgtcaataaagaaaaggtggtgggacgggtcatcagctctacgcccctcgctgagaacaccaactccgtgacaaatattgagctggaaccccctttcggcgacagctatatcgttatcggggtgggaaactctgcccttaccctgcattggtttagaaaaggcagctccattgggaagatgttcgagtctacataccgcggagcgaaacggatggctatcctcggcgaaaccgcctgggattttgggagcgtcggcggactgttcacctccctgggcaaggccgtgcaccaggtttttgggagcgtgtatacaacgatgttcggaggcgtctcttggatgattagaatcctcattgggtttctggtgctttggatcggaaccaattcccgcaacacaagcatggctatgacctgtatcgccgttggcgggattacactgttcctcggctttaccgtgcaggct

SEQ ID NO: 2094 - RNA, 2025 nt, synthetic construct
  misc_feature 1..2025: note = derived and/or modified CDS sequence (opt5) from DENV-4 Consensus__SSc-prME
  source 1..2025: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggaatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaagaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacaccaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggcc

SEQ ID NO: 2095 - RNA, 2322 nt, synthetic construct
  misc_feature 1..2322: note = derived and/or modified CDS sequence (opt5) from DENV-4 Consensus__C-prME
  source 1..2322: mol_type = other RNA
atgaaccagagaaagaaagtggtccggccccctttcaatatgctgaagcgcgagagaaaccgggttagcaccccgcaaggcctcgtgaaacgcttttccacagggctgttctctggaaagggcccccttagaatggtgctggcctttatcacgttcctccgggtcctgagcattcctcccaccgctgggatccttaaacgctggggacagctgaagaagaataaagccattaagatcctcattggctttagaaaagaaatcgggcggatgctgaacatcctgaatggacgcaagagatccacaattaccctcctgtgccttatccctacagtgatggcgttccacctgtctacccgggacggcgagcccctcatgattgttgctaaacatgaacgcggcagacctctgctttttaagacaaccgaggggatcaacaagtgtacgctgattgccatggatctcggagaaatgtgcgaggacaccgtgacatacaaatgtccgctgctggtcaataccgagcccgaagatatcgactgctggtgtaacctcacaagcacctgggtgatgtatggcacgtgcacacagtccggggagcggcgcagagaaaagcggtctgttgccctgacccctcacagcggaatgggccttgagacaagagctgagacctggatgtccagcgaaggggcctggaaacatgctcagcgcgtggagtcttggattctgcggaatcccggattcgccctcctggcgggctttatggcctacatgatcggccaaaccgggatccagagaacagtcttctttgtgcttatgatgctggtggctccttcctatggaatgcgctgtgtcggcgttgggaaccgggatttcgtggaaggagtgagcggcggggcctgggtcgacctcgtgctggagcacggaggctgcgttacgaccatggctcagggcaagcccacactggattttgaactcaccaaaacaaccgccaaggaggtggcgctgcttagaacgtactgtattgaggcctctatctccaatattacaaccgctacccgctgcccgacacagggggaaccttatctgaaagaggaacaagaccagcagtacatctgtcggagagatgtcgtggaccgcggatggggcaacgggtgcggactcttcggcaaagggggcgttgtgacctgcgccaagttcagctgttctggaaagattacaggcaatctggtccagatcgagaaccttgaatatacggtggtcgtgaccgttcataatggggatacacacgctgtgggaaacgacacctccaaccacggcgtcacagccaccatcacgccccggagcccttccgtggaggttaagctgcccgattacggggagctcaccctggactgcgaacccagatctggaattgactttaatgagatgatcctgatgaaaatgaagaaaaagacatggctcgtgcataagcaatggttcctggatcttcctctgccgtggaccgccggcgctgacacaagcgaagtccactggaactacaaagagcgcatggtgacctttaaggtgccccatgcgaaacggcaggatgttacggtcctcgggtcccaggaaggcgccatgcacagcgctctggccggagccacagaggtggactctggcgatgggaatcacatgttcgctggacatctgaagtgtaaagtgagaatggagaaacttcggattaagggcatgtcctataccatgtgcagcgggaagttttctatcgacaaggaaatggccgagacacaacacggaaccaccgtcgtgaaagttaagtacgaaggcgcgggggctccttgtaaagtgcccattgagatccgcgatgtcaacaaggagaaggtggttggcagagtgatcagctccacacctctcgccgaaaatacgaactctgtcaccaatattgagctggaacccccgttcggagacagctatatcgtgattggcgttgggaactccgccctgacactccattggtttcggaaaggaagctctatcggcaagatgttcgagtccacctacagaggggctaaacgcatggccattctgggagaaacagcttgggattttggcagcgtcgggggccttttcacctctctgggaaaggccgtgcaccaggtgtttggctccgtgtatacgacaatgttcgggggagtcagctggatgatccggattctcatcggctttctggttctgtggatcgggaccaattccagaaacacctctatggcgatgacatgcattgccgtgggaggcatcacccttttcctcggcttcacagtgcaggct

SEQ ID NO: 2096 - RNA, 45 nt, synthetic construct
  misc_feature 1..45: note = derived and/or modified CDS sequence (opt5) from DENV-4 Consensus__SSc
  source 1..45: mol_type = other RNA
atgagcaccatcacactgctctgcctgattcccacggtgatggcc

SEQ ID NO: 2097 - RNA, 57 nt, synthetic construct
  misc_feature 1..57: note = derived and/or modified CDS sequence (opt5) from DENV-4 Consensus__SSopt
  source 1..57: mol_type = other RNA
atgaagagaaagaaaagcaccatcacactgctctgcctgattcccacggtgatggcc

SEQ ID NO: 2098 - RNA, 57 nt, synthetic construct; identical to SEQ ID NO: 1794
  misc_feature 1..57: note = derived and/or modified CDS sequence (opt5) from DENV-4 Consensus__SSm
  source 1..57: mol_type = other RNA

SEQ ID NO: 2099 - RNA, 1488 nt, synthetic construct
  misc_feature 1..1488: note = derived and/or modified CDS sequence (opt5) from DENV-4 Consensus__E
  source 1..1488: mol_type = other RNA
atgagatgcgtgggcgtcgggaaccgggacttcgttgagggagtgagcggcggggcctgggtggatctggtcctcgaacacggaggctgtgtgaccacaatggctcaggggaagcccacgctggactttgagcttaccaaaacaaccgccaaggaagttgcgctgctccgcacatactgcatcgaggcttccatttctaatatcaccacagccaccagatgtcctacgcaaggagaaccgtatctgaaagaggagcaggatcagcagtacatttgccggcgcgacgtggtcgatagaggctggggcaacgggtgtggacttttcggcaaagggggagtggttacctgcgccaagtttagctgttccggcaagatcacagggaatctggtgcaaattgaaaacctcgagtataccgtcgtggtgacagtccataatggagacacccacgctgttggcaacgatacgtctaatcatggcgtgacagccaccatcacaccccggagcccttccgtggaagtcaagctgcccgactacggggagctgaccctcgattgcgagcctcgctctggaatcgacttcaacgaaatgattctgatgaaaatgaagaaaaagacctggcttgtgcacaaacagtggtttctggatctccccctgccttggacagctggcgccgacacgagcgaggttcattggaattataaggaaagaatggtgaccttcaaggtcccgcacgcgaaacggcaggatgtgacagttcttgggtcccaggagggagccatgcacagcgctctggccggcgctaccgaagtggactctggggacggaaaccatatgtttgccggccacctcaagtgtaaagtccgcatggagaagctgagaatcaaaggcatgtcctacacaatgtgcagcgggaagttctctattgataaagagatggcggaaacccaacatggaacgacagtggtcaaggtgaagtatgagggcgccggggctccctgtaaagttcctatcgaaattcgggacgtgaataaggagaaagtcgtgggacgcgttatctccagcacacccctggccgaaaacaccaattctgtgaccaacattgagctcgagcctccctttggcgattcctacatcgtcatcggggtgggcaatagcgctctgacccttcactggttcagaaagggatcctctattggcaaaatgtttgaaagcacataccgcggggccaagcggatggccatcctgggagagacggcttgggacttcggctccgttgggggactctttaccagcctgggcaaggcggtgcaccaggtcttcgggtctgtgtatacaaccatgttcggcggagtgtcctggatgattagaatccttattggctttctggtcctctggatcgggacaaacagccggaacacctctatggccatgacgtgcatcgctgtgggaggcattaccctgttcctggggtttacagttcaggcctga

SEQ ID NO: 2100 - RNA, 1182 nt, synthetic construct
  misc_feature 1..1182: note = derived and/or modified CDS sequence (opt5) from DENV-4 Consensus__EdelTM-variant (aa1-394)
  source 1..1182: mol_type = other RNA
atgagatgcgtgggcgtcgggaaccgggacttcgttgagggagtgagcggcggggcctgggtggatctggtcctcgaacacggaggctgtgtgaccacaatggctcaggggaagcccacgctggactttgagcttaccaaaacaaccgccaaggaagttgcgctgctccgcacatactgcatcgaggcttccatttctaatatcaccacagccaccagatgtcctacgcaaggagaaccgtatctgaaagaggagcaggatcagcagtacatttgccggcgcgacgtggtcgatagaggctggggcaacgggtgtggacttttcggcaaagggggagtggttacctgcgccaagtttagctgttccggcaagatcacagggaatctggtgcaaattgaaaacctcgagtataccgtcgtggtgacagtccataatggagacacccacgctgttggcaacgatacgtctaatcatggcgtgacagccaccatcacaccccggagcccttccgtggaagtcaagctgcccgactacggggagctgaccctcgattgcgagcctcgctctggaatcgacttcaacgaaatgattctgatgaaaatgaagaaaaagacctggcttgtgcacaaacagtggtttctggatctccccctgccttggacagctggcgccgacacgagcgaggttcattggaattataaggaaagaatggtgaccttcaaggtcccgcacgcgaaacggcaggatgtgacagttcttgggtcccaggagggagccatgcacagcgctctggccggcgctaccgaagtggactctggggacggaaaccatatgtttgccggccacctcaagtgtaaagtccgcatggagaagctgagaatcaaaggcatgtcctacacaatgtgcagcgggaagttctctattgataaagagatggcggaaacccaacatggaacgacagtggtcaaggtgaagtatgagggcgccggggctccctgtaaagttcctatcgaaattcgggacgtgaataaggagaaagtcgtgggacgcgttatctccagcacacccctggccgaaaacaccaattctgtgaccaacattgagctcgagcctccctttggcgattcctacatcgtcatcggggtgggcaatagcgctctgacccttcactggttcagaaag

SEQ ID NO: 2101 - RNA, 1272 nt, synthetic construct
  misc_feature 1..1272: note = derived and/or modified CDS sequence (opt5) from DENV-4 Consensus__EdelTM-variant (aa1-424)
  source 1..1272: mol_type = other RNA
atgagatgcgtgggcgtcgggaaccgggacttcgttgagggagtgagcggcggggcctgggtggatctggtcctcgaacacggaggctgtgtgaccacaatggctcaggggaagcccacgctggactttgagcttaccaaaacaaccgccaaggaagttgcgctgctccgcacatactgcatcgaggcttccatttctaatatcaccacagccaccagatgtcctacgcaaggagaaccgtatctgaaagaggagcaggatcagcagtacatttgccggcgcgacgtggtcgatagaggctggggcaacgggtgtggacttttcggcaaagggggagtggttacctgcgccaagtttagctgttccggcaagatcacagggaatctggtgcaaattgaaaacctcgagtataccgtcgtggtgacagtccataatggagacacccacgctgttggcaacgatacgtctaatcatggcgtgacagccaccatcacaccccggagcccttccgtggaagtcaagctgcccgactacggggagctgaccctcgattgcgagcctcgctctggaatcgacttcaacgaaatgattctgatgaaaatgaagaaaaagacctggcttgtgcacaaacagtggtttctggatctccccctgccttggacagctggcgccgacacgagcgaggttcattggaattataaggaaagaatggtgaccttcaaggtcccgcacgcgaaacggcaggatgtgacagttcttgggtcccaggagggagccatgcacagcgctctggccggcgctaccgaagtggactctggggacggaaaccatatgtttgccggccacctcaagtgtaaagtccgcatggagaagctgagaatcaaaggcatgtcctacacaatgtgcagcgggaagttctctattgataaagagatggcggaaacccaacatggaacgacagtggtcaaggtgaagtatgagggcgccggggctccctgtaaagttcctatcgaaattcgggacgtgaataaggagaaagtcgtgggacgcgttatctccagcacacccctggccgaaaacaccaattctgtgaccaacattgagctcgagcctccctttggcgattcctacatcgtcatcggggtgggcaatagcgctctgacccttcactggttcagaaagggatcctctattggcaaaatgtttgaaagcacataccgcggggccaagcggatggccatcctgggagagacggcttgggacttcggctcc

SEQ ID NO: 2102 - RNA, 1266 nt, synthetic construct
  misc_feature 1..1266: note = derived and/or modified CDS sequence (opt5) from DENV-4 Consensus__EdelTM-variant (aa1-421)
  source 1..1266: mol_type = other RNA
atgagatgcgtgggcgtcgggaaccgggacttcgttgagggagtgagcggcggggcctgggtggatctggtcctcgaacacggaggctgtgtgaccacaatggctcaggggaagcccacgctggactttgagcttaccaaaacaaccgccaaggaagttgcgctgctccgcacatactgcatcgaggcttccatttctaatatcaccacagccaccagatgtcctacgcaaggagaaccgtatctgaaagaggagcaggatcagcagtacatttgccggcgcgacgtggtcgatagaggctggggcaacgggtgtggacttttcggcaaagggggagtggttacctgcgccaagtttagctgttccggcaagatcacagggaatctggtgcaaattgaaaacctcgagtataccgtcgtggtgacagtccataatggagacacccacgctgttggcaacgatacgtctaatcatggcgtgacagccaccatcacaccccggagcccttccgtggaagtcaagctgcccgactacggggagctgaccctcgattgcgagcctcgctctggaatcgacttcaacgaaatgattctgatgaaaatgaagaaaaagacctggcttgtgcacaaacagtggtttctggatctccccctgccttggacagctggcgccgacacgagcgaggttcattggaattataaggaaagaatggtgaccttcaaggtcccgcacgcgaaacggcaggatgtgacagttcttgggtcccaggagggagccatgcacagcgctctggccggcgctaccgaagtggactctggggacggaaaccatatgtttgccggccacctcaagtgtaaagtccgcatggagaagctgagaatcaaaggcatgtcctacacaatgtgcagcgggaagttctctattgataaagagatggcggaaacccaacatggaacgacagtggtcaaggtgaagtatgagggcgccggggctccctgtaaagttcctatcgaaattcgggacgtgaataaggagaaagtcgtgggacgcgttatctccagcacacccctggccgaaaacaccaattctgtgaccaacattgagctcgagcctccctttggcgattcctacatcgtcatcggggtgggcaatagcgctctgacccttcactggttcagaaagggatcctctattggcaaaatgtttgaaagcacataccgcggggccaagcggatggccatcctgggagagacggcttgggactga

SEQ ID NO: 2103 - RNA, 2031 nt, synthetic construct
  misc_feature 1..2031: note = derived and/or modified CDS sequence (opt5) from DENV-4 Consensus__SSc-prME
  source 1..2031: mol_type = other RNA
atgagcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggaatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaagaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacaccaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggcctga

SEQ ID NO: 2104 - RNA, 2031 nt, synthetic construct
  misc_feature 1..2031: note = derived and/or modified CDS sequence (opt5) from DENV-4 Consensus__SSc-prME(F108S)
  source 1..2031: mol_type = other RNA
atgagcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggaatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgtccgggaaaggaggcgtcgtgacatgcgcgaagttcagctgttctggcaaaatcaccgggaatctcgttcaaattgagaacctggaatataccgtggtcgtgacagttcataatggagatacccacgccgtgggcaacgacacatccaatcacggggtcacggctaccatcacacctagaagcccctctgtggaggtcaaacttcctgattacggagaactgaccctcgactgcgagccccggtccggcatcgactttaacgagatgattctgatgaagatgaagaagaaaacatggctggtgcataagcagtggttcctcgatctgccgcttccttggaccgccggggctgacacgagcgaagttcactggaattacaaagagagaatggtgacctttaaggtcccccatgccaaacgccaggatgtgacagttctgggctcccaggaaggagccatgcactctgctctcgcgggcgccaccgaggtggacagcggggatggaaaccacatgttcgctggccatctgaagtgtaaggtccggatggaaaaacttagaatcaaggggatgtcctatacaatgtgcagcggaaaattttctattgacaaggagatggccgagacccaacacggcacgacagtggtgaaagttaagtacgaaggggccggcgctccttgtaaggtccccatcgagattcgcgatgtgaataaagaaaaggtggtcggacgggtgatctccagcacacccctggccgagaacaccaactctgttaccaatatcgagctcgaacctccgttcggcgacagctatattgtgatcggggtcggaaactccgcgctgaccctgcattggttcagaaaaggctctagcattgggaagatgtttgagtccacataccgcggagctaaacggatggccatcctcggcgaaacggcctgggatttcgggagcgtgggcggactgtttacctctcttggcaaggctgttcaccaggtgttcgggtccgtctatacaaccatgtttggaggcgtgagctggatgattagaatcctgatcgggttcctcgttctgtggattggaacaaattctcgcaacacctccatggccatgacgtgcatcgctgtgggcgggattacactgtttcttggcttcaccgtccaggcctga

SEQ ID NO: 2105 - RNA, 2031 nt, synthetic construct
  misc_feature 1..2031: note = derived and/or modified CDS sequence (opt5) from DENV-4 Consensus__SSc-prMEdelstem_TM-JEV
  source 1..2031: mol_type = other RNA
atgagcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggaatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaagaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacaccaacagcgttaccaatatcgagctcgaacctccgttcggcgactcttatattgtgatcggggtcggaaacagcgcgctgaccctgcattggtttagaaaaggctccacactcgggaaggctttctctacgaccctgaaaggagcccagcgccttgccgctctgggcgatacagcctgggactttgggagcattggcggagtgttcaattccatcggccgggctgttcaccaggtgtttgggggagccttcagaaccctctttggcgggatgagctggattacacaaggactgatgggcgcgctgcttctctggatgggggtcaacgcccgcgatcggtctatcgctctggccttcctggctaccggcggagtgctcgtttttctggccacgaatgtgcatgcgtga

SEQ ID NO: 2106 - RNA, 1332 nt, synthetic construct
  misc_feature 1..1332: note = derived and/or modified CDS sequence (opt5) from DENV-4 Consensus__SSm-EdelTM
  source 1..1332: mol_type = other RNA
atgatccagagaaccgtgttctttgtcctgatgatgctcgttgcccccagctacggcatgcggtgcgtgggggtgggaaaccgcgacttcgtcgagggcgtgtccgggggagcttgggttgatctggtgcttgaacacggcgggtgtgtcacaacgatggcccaaggaaagcctaccctggactttgagctcacaaaaaccacagcgaaggaagtggctctgcttagaacctattgcattgaggcctctatcagcaatattacaaccgccacgcggtgtccgacccagggcgaaccctacctgaaagaggagcaggatcagcaatatatctgccgcagagacgttgtggatcggggctgggggaacggatgtggcctcttcgggaagggaggcgtcgtgacatgcgctaaattttcctgttctgggaagattaccggaaatctggtgcagatcgaaaacctggagtacacagtcgttgtgaccgtgcataatggcgacacgcacgccgtcggcaacgatacaagcaatcatggggtgaccgctacaatcacccctcgctccccctctgttgaagtgaagctccctgactatggagagctgacccttgattgcgagcccagaagcggcattgacttcaacgaaatgatcctgatgaaaatgaagaaaaagacatggctcgtccacaaacagtggtttctggatcttcctctgccgtggacggccggggcggacacctccgaggtgcattggaattacaaggaacggatggttacattcaaggtgccccacgccaaacgccaggatgtcaccgtgctcggaagccaagagggcgctatgcactctgccctggctggggccacagaagtcgactccggagacggcaaccatatgtttgcgggccacctgaagtgtaaagtgagaatggagaagctccggattaaagggatgagctataccatgtgctctggaaagttctccatcgataaagagatggccgaaacgcagcatggcacaaccgttgtgaaggtcaagtacgagggggctggagccccttgtaaagtgcccattgaaatccgcgacgttaataaggagaaagtggtcggcagagtgattagctctacccctctggctgaaaacacaaattccgtgaccaacatcgagcttgagcccccgtttggggatagctacatcgttattggcgtcggaaattccgccctgacactccactggttccggaagggctctagcatcgggaaaatgtttgaatccacgtatcgcggagccaagagaatggctattctgggcgagaccgcgtgggacttcgggagctga

SEQ ID NO: 2107 - RNA, 2376 nt, synthetic construct
  misc_feature 1..2376: note = derived and/or modified CDS sequence (opt5) from DENV-4 Consensus__C-P2A-SSc-prME
  source 1..2376: mol_type = other RNA
atgaaccagagaaagaaagtggtccggccccctttcaatatgctgaagcgcgagagaaaccgggttagcaccccgcaaggcctcgtgaaacgcttttccacagggctgttctctggaaagggcccccttagaatggtgctggcctttatcacgttcctccgggtcctgagcattcctcccaccgctgggatccttaaacgctggggacagctgaagaagaataaagccattaagatcctcattggctttagaaaagaaatcgggcggatgctgaacatcctgaatggacgcaagagaaacttcgacctcctgaaacttgcgggcgatgtggagtccaatcctggcccctctacaattaccctgctctgcctgatccctacagttatggcttttcaccttagcacccgggacggggaaccgctgatgattgtggccaagcatgagcgcggaagacccctcctgttcaagacaaccgaaggcatcaacaaatgtacgctgattgccatggatctcggggagatgtgcgaggacaccgtcacatacaagtgtcctctgcttgtgaataccgaacccgaggatatcgactgctggtgtaacctgacatccacctgggttatgtatggaacgtgcacacagtctggcgaacggcgcagagagaaacggagcgtggctctcacccctcactccgggatgggactggagacaagagccgaaacctggatgagctctgagggcgcttggaagcatgcccagcgcgtcgaatcctggattcttcggaatcccggctttgcgctgctcgccgggttcatggcttacatgatcggacaaaccggcatccagagaacagtgtttttcgtgctgatgatgctggtcgccccgagctatgggatgcgctgtgttggagtgggcaaccgggattttgtggagggggtctctggaggcgcttgggtggacctcgttctggaacacggcgggtgcgtgacgaccatggcccagggaaaacctacacttgatttcgagctgaccaagacaaccgcgaaagaggtcgccctcctgagaacgtactgtattgaggcttccatcagcaatattacaaccgccacccgctgccccacacagggcgagccttatcttaaggaagaacaagaccagcagtacatctgtcggagagatgtggttgaccgcgggtggggaaacggctgcgggctgttcggcaagggaggcgtggtgacctgcgctaaattttcttgttccgggaagattacaggaaatctcgtccagatcgaaaacctggagtatacggtcgtggttaccgtgcataacggcgatacacacgccgtcgggaatgacaccagcaaccacggagtgacagccaccatcacgccccggtccccctctgttgaggtgaaactgcctgactacggcgaactcaccctggattgcgagccgagaagcgggattgacttcaatgaaatgatccttatgaagatgaaaaagaagacatggctggtccataaacaatggtttctcgatctgcccctgccttggaccgctggcgcggacacatccgaggtgcactggaactacaaggaacgcatggtgaccttcaaagttccccatgccaagcggcaggatgtcacggtgcttggaagccaggagggcgctatgcactctgccctcgccggggctacagaggtggactccggagatggcaatcacatgtttgccgggcatctgaaatgtaaggtcagaatggaaaagctgcggattaaaggaatgagctataccatgtgctctggcaagttcagcatcgacaaagagatggcggaaacacaacacgggaccaccgtggttaaggtgaaatacgagggcgctggagccccttgtaaggtccccattgagatccgcgatgtgaacaaggaaaaagttgtgggcagagtcatctcctctacaccgctcgccgagaatacgaacagcgtgaccaatattgaactggagcctccctttggggactcctatatcgttattggagtgggcaacagcgctcttacactgcattggttccggaaggggtcttccatcggaaaaatgtttgaaagcacctacagaggcgccaagcgcatggctattctcggggagacagcctgggatttcggctctgtcggaggcctgtttacctccctggggaaagcggtgcaccaggtgttcggaagcgtctatacgacaatgtttggcggggtttcctggatgatccggattcttatcggattcctcgtgctgtggatcggcaccaattctagaaacaccagcatggccatgacatgcattgctgtgggcgggatcaccctgttcctcggatttacagtccaggcctga

SEQ ID NO: 2108 - RNA, 2043 nt, synthetic construct
  misc_feature 1..2043: note = derived and/or modified CDS sequence (opt5) from DENV-4 Consensus__SSopt-prME(F108S)
  source 1..2043: mol_type = other RNA
atgaagcggaaaaagagcaccatcacactgctctgcctgattcccacggtgatggccttccacctttccaccagagacggcgagcctctgatgatcgtcgctaaacatgaacgcgggagaccgctcctgtttaagacaaccgagggaattaacaaatgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagcggcgcagagaaaagcggtccgtcgcgctcacaccccactctggcatggggctggagacccgcgctgaaacgtggatgagctccgagggagcctggaaacatgcccaaagagtggagtcttggatccttcggaatcctggcttcgctctgctcgccggctttatggcttacatgatcgggcagacaggcattcagcgcaccgttttctttgtgctgatgatgcttgtcgcccccagctatggaatgagatgtgtgggggttggaaaccgggatttcgtggaaggcgtctccgggggagcgtgggtggacctggtgctcgagcacggcggctgcgtcacaaccatggcccaggggaagcctaccctggattttgaactgacaaaaacgaccgctaaggaggttgccctcctgcgcacatactgtatcgaagctagcatttctaatatcaccacagccaccagatgcccgacgcaaggagagccctatcttaaagaggaacaggaccagcagtacatttgtcggcgcgatgtggtggacagaggctgggggaacggatgcggcctgtccgggaagggaggcgtcgtgacatgcgcgaagttcagctgttctggcaaaatcaccgggaatctcgttcaaattgagaacctggaatataccgtggtcgtgacagttcataatggagatacccacgccgtgggcaacgacacatccaatcacggggtcacggctaccatcacacctcggagcccctctgtggaggtcaaacttcctgattacggagaactgaccctcgactgcgagcccagatccggcatcgactttaacgagatgattctgatgaagatgaagaaaaagacatggctggtgcataaacagtggttcctcgatctgccgcttccttggaccgccggggctgacacgagcgaagttcactggaattacaaggagcgcatggtgacctttaaggtcccccatgccaaacggcaggatgtgacagttctgggctcccaggaaggagccatgcactctgctctcgcgggcgccaccgaggtggacagcggggatggaaaccacatgttcgctggccatctgaagtgtaaagtcagaatggaaaaacttcgcatcaaggggatgtcctatacaatgtgcagcggaaagttttctattgacaaggagatggccgagacccaacacggcacgacagtggtgaaagttaagtacgaaggggccggcgctccttgtaaagtccccatcgagattcgggatgtgaataaggaaaaagtggtcggaagagtgatctccagcacacccctggccgagaacaccaactctgttaccaatatcgagctcgaacctccgttcggcgacagctatattgtgatcggggtcggaaactccgcgctgaccctgcattggttccgcaagggctctagcattgggaagatgtttgagtccacataccggggagctaaaagaatggccatcctcggcgaaacggcctgggatttcgggagcgtgggcggactgtttacctctcttggcaaggctgttcaccaggtgttcgggtccgtctatacaaccatgtttggaggcgtgagctggatgattcgcatcctgatcgggttcctcgttctgtggattggaacaaattctcggaacacctccatggccatgacgtgcatcgctgtgggcgggattacactgtttcttggcttcaccgtccaggcctga

SEQ ID NO: 2109 - RNA, 2043 nt, synthetic construct
  misc_feature 1..2043: note = derived and/or modified CDS sequence (opt5) from DENV-4 Consensus__SSopt-prME(V96H)
  source 1..2043: mol_type = other RNA
atgaagcggaaaaagagcaccatcacactgctctgcctgattcccacggtgatggccttccacctttccaccagagacggcgagcctctgatgatcgtcgctaaacatgaacgcgggagaccgctcctgtttaagacaaccgagggaattaacaaatgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagcggcgcagagaaaagcggtccgtcgcgctcacaccccactctggcatggggctggagacccgcgctgaaacgtggatgagctccgagggagcctggaaacatgcccaaagagtggagtcttggatccttcggaatcctggcttcgctctgctcgccggctttatggcttacatgatcgggcagacaggcattcagcgcaccgttttctttgtgctgatgatgcttgtcgcccccagctatggaatgagatgtgtgggggttggaaaccgggatttcgtggaaggcgtctccgggggagcgtgggtggacctggtgctcgagcacggcggctgcgtcacaaccatggcccaggggaagcctaccctggattttgaactgacaaaaacgaccgctaaggaggttgccctcctgcgcacatactgtatcgaagctagcatttctaatatcaccacagccaccagatgcccgacgcaaggagagccctatcttaaagaggaacaggaccagcagtacatttgtcggcgcgatcatgtggacagaggctgggggaacggatgcggcctgttcgggaagggaggcgtggtcacatgcgcgaagttttcctgtagcggcaaaatcaccgggaatctcgtgcaaattgagaacctggaatataccgttgtggtcacagtgcacaatggagatacccacgccgttggcaacgacacatctaatcatggggtgacggctaccatcacacctcggtcccccagcgtcgaggtgaaacttcctgattacggagaactgaccctcgactgcgagcccagatctggcatcgacttcaacgagatgattctgatgaagatgaagaaaaagacatggctggtccacaaacagtggtttctcgatctgccgcttccttggaccgccggggctgacacgtccgaagtgcattggaattacaaggagcgcatggttaccttcaaggtgccccacgccaaacggcaggatgtcacagtgctgggcagccaggaaggagccatgcactccgctctcgcgggcgccaccgaggttgactctggggatggaaaccatatgtttgctggccacctgaagtgtaaagtgagaatggaaaaacttcgcatcaaggggatgagctatacaatgtgctccggaaagttcagcattgacaaggagatggccgagacccaacatggcacgacagtcgtgaaagtgaagtacgaaggggccggcgctccttgtaaagttcccatcgagattcgggatgtcaataaggaaaaagtggtgggaagagtcatctcttccacacccctggccgagaacaccaacagcgtgaccaatatcgagctcgaacctccgttcggcgactcttatattgttatcggggtgggaaacagcgcgctgaccctgcactggtttcgcaagggctcctctattgggaagatgttcgagagcacataccggggagctaaaagaatggccatcctcggcgaaacggcctgggattttgggtccgtcggcggactgttcaccagccttggcaaggctgtgcatcaggtttttgggtctgtgtatacaaccatgttcggaggcgtctcctggatgattcgcatcctgatcgggtttctcgtgctgtggattggaacaaatagccggaacacctctatggccatgacgtgcatcgctgttggcgggattacactgttccttggctttaccgtgcaggcctga

SEQ ID NO: 2110 - RNA, 2043 nt, synthetic construct
  misc_feature 1..2043: note = derived and/or modified CDS sequence (opt5) from DENV-4 Consensus__SSopt-prME(E186F)
  source 1..2043: mol_type = other RNA
atgaagcggaaaaagagcaccatcacactgctctgcctgattcccacggtgatggccttccacctttccaccagagacggcgagcctctgatgatcgtcgctaaacatgaacgcgggagaccgctcctgtttaagacaaccgagggaattaacaaatgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagcggcgcagagaaaagcggtccgtcgcgctcacaccccactctggcatggggctggagacccgcgctgaaacgtggatgagctccgagggagcctggaaacatgcccaaagagtggagtcttggatccttcggaatcctggcttcgctctgctcgccggctttatggcttacatgatcgggcagacaggcattcagcgcaccgttttctttgtgctgatgatgcttgtcgcccccagctatggaatgagatgtgtgggggttggaaaccgggatttcgtggaaggcgtctccgggggagcgtgggtggacctggtgctcgagcacggcggctgcgtcacaaccatggcccaggggaagcctaccctggattttgaactgacaaaaacgaccgctaaggaggttgccctcctgcgcacatactgtatcgaagctagcatttctaatatcaccacagccaccagatgcccgacgcaaggagagccctatcttaaagaggaacaggaccagcagtacatttgtcggcgcgatgtggtggacagaggctgggggaacggatgcggcctgttcgggaagggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctcggtcccccagcgtggaggtcaaacttcctgattacggagaactgaccctcgactgcttccccagatctggcatcgactttaacgagatgattctgatgaagatgaagaaaaagacatggctggtgcataaacagtggttcctcgatctgccgcttccttggaccgccggggctgacacgtccgaggttcactggaattacaaggaacgcatggtgacctttaaggtcccccatgccaaacggcaggatgtgacagttctgggcagccaggagggagccatgcactccgctctcgcgggcgccaccgaagtggactctggggatggaaaccacatgttcgctggccatctgaagtgtaaagtcagaatggagaaacttcgcatcaaggggatgagctatacaatgtgctccggaaagttcagcattgacaaggaaatggccgagacccaacacggcacgacagtggtgaaagttaagtacgagggggccggcgctccttgtaaagtccccatcgaaattcgggatgtgaataaggagaaagtggtcggaagagtgatctcttccacacccctggccgaaaacaccaacagcgttaccaatatcgagctcgagcctccgtttggcgactcttatattgtgatcggggtcggaaacagcgcgctgaccctgcattggttccgcaagggctcctctattgggaagatgtttgaaagcacataccggggagctaaaagaatggccatcctcggcgagacggcctgggatttcgggtccgtgggcggactgtttaccagccttggcaaggctgttcaccaggtgttcgggtctgtctatacaaccatgtttggaggcgtgtcctggatgattcgcatcctgatcgggttcctcgttctgtggattggaacaaatagccggaacacctctatggccatgacgtgcatcgctgtgggcgggattacactgtttcttggcttcaccgtccaggcctga

SEQ ID NO: 2111 - RNA, 2043 nt, synthetic construct
  misc_feature 1..2043: note = derived and/or modified CDS sequence (opt5) from DENV-4 Consensus__SSopt-prME(R188L)
  source 1..2043: mol_type = other RNA
atgaagcggaaaaagagcaccatcacactgctctgcctgattcccacggtgatggccttccacctttccaccagagacggcgagcctctgatgatcgtcgctaaacatgaacgcgggagaccgctcctgtttaagacaaccgagggaattaacaaatgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagcggcgcagagaaaagcggtccgtcgcgctcacaccccactctggcatggggctggagacccgcgctgaaacgtggatgagctccgagggagcctggaaacatgcccaaagagtggagtcttggatccttcggaatcctggcttcgctctgctcgccggctttatggcttacatgatcgggcagacaggcattcagcgcaccgttttctttgtgctgatgatgcttgtcgcccccagctatggaatgagatgtgtgggggttggaaaccgggatttcgtggaaggcgtctccgggggagcgtgggtggacctggtgctcgagcacggcggctgcgtcacaaccatggcccaggggaagcctaccctggattttgaactgacaaaaacgaccgctaaggaggttgccctcctgcgcacatactgtatcgaagctagcatttctaatatcaccacagccaccagatgcccgacgcaaggagagccctatcttaaagaggaacaggaccagcagtacatttgtcggcgcgatgtggtggacagaggctgggggaacggatgcggcctgttcgggaagggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctcggtcccccagcgtggaggtcaaacttcctgattacggagaactgaccctcgactgcgagcccctgtctggcatcgacttcaacgagatgattctgatgaagatgaagaaaaagacatggctcgtgcataaacagtggtttctggatcttccgctgccttggaccgccggggctgacacgtccgaagttcactggaattacaaggagagaatggtgaccttcaaggtcccccatgccaaacgccaggatgtgacagttctcggcagccaggaaggagccatgcactccgctctggcgggcgccaccgaggtggactctggggatggaaaccacatgtttgctggccatcttaagtgtaaagtccggatggaaaagctgagaatcaaagggatgagctatacaatgtgctccggaaagttcagcattgacaaggagatggccgagacccaacacggcacgacagtggtgaaagttaagtacgaaggggccggcgctccttgtaaagtccccatcgagattcgcgatgtgaataaggaaaaagtggtcggacgggtgatctcttccacacccctcgccgagaacaccaacagcgttaccaatatcgagctggaacctccgttcggcgactcttatattgtgatcggggtcggaaacagcgcgctgaccctccattggtttagaaagggctcctctattgggaagatgttcgagagcacataccgcggagctaaacggatggccatcctgggcgaaacggcctgggattttgggtccgtgggcggacttttcaccagcctgggcaaggctgttcaccaggtgtttgggtctgtctatacaaccatgttcggaggcgtgtcctggatgattagaatcctcatcgggtttctggttctgtggattggaacaaatagccgcaacacctctatggccatgacgtgcatcgctgtgggcgggattacacttttcctcggctttaccgtccaggcctga

SEQ ID NO: 2112 - RNA, 2043 nt, synthetic construct
  misc_feature 1..2043: note = derived and/or modified CDS sequence (opt5) from DENV-4 Consensus__SSopt-pr(D104A)MEdelstem_TM,(F108S)-JEV
  source 1..2043: mol_type = other RNA
atgaagcggaaaaagagcaccatcacactgctctgcctgattcccacggtgatggccttccacctttccaccagagacggcgagcctctgatgatcgtcgctaaacatgaacgcgggagaccgctcctgtttaagacaaccgagggaattaacaaatgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagcggcgcagagcgaagcggtccgtcgctctcacaccccactctggcatggggctggaaacccgcgccgagacgtggatgagctccgaaggagcctggaaacatgctcaaagagtggagtcttggatccttcggaatcctggcttcgccctgctcgctggctttatggcctacatgatcgggcagacaggcattcagcgcaccgttttctttgtgctgatgatgcttgtcgcgcccagctatggaatgagatgtgtgggggttggaaaccgggatttcgtggagggcgtctccgggggagcctgggtggacctggtgctcgaacacggcggctgcgtcacaaccatggctcaggggaagcctaccctggattttgagctgacaaaaacgaccgccaaggaagttgctctcctgcgcacatactgtatcgaggccagcatttctaatatcaccacagcgaccagatgcccgacgcaaggagaaccctatcttaaagaggagcaggaccagcagtacatttgtcggcgcgatgtggtggacagaggctgggggaacggatgcggcctgtccgggaagggaggcgtcgtgacatgcgccaagttcagctgttctggcaaaatcaccgggaatctcgttcaaattgaaaacctggagtataccgtggtcgtgacagttcataatggagatacccacgctgtgggcaacgacacatccaatcacggggtcacggccaccatcacacctcggagcccctctgtggaagtcaaacttcctgattacggagagctgaccctcgactgcgaacccagatccggcatcgactttaacgagatgattctgatgaagatgaagaaaaagacatggctggtgcataaacagtggttcctcgatctgccgcttccttggaccgctggggccgacacgagcgaggttcactggaattacaaggaacgcatggtgacctttaaggtcccccatgccaaacggcaggatgtgacagttctgggctcccaggagggagctatgcactctgcgctcgccggcgctaccgaagtggacagcggggatggaaaccacatgttcgccggccatctgaagtgtaaagtcagaatggagaaacttcgcatcaaggggatgtcctatacaatgtgcagcggaaagttttctattgacaaggaaatggccgagacccaacacggcacgacagtggtgaaagttaagtacgagggggctggcgccccttgtaaagtccccatcgaaattcgggatgtgaataaggagaaagtggtcggaagagtgatctccagcacacccctggcggaaaacaccaactctgttaccaatatcgagctcgagcctccgttcggcgacagctatattgtgatcggggtcggaaactccgctctgaccctgcattggttccgcaagggctctacactcgggaaggcctttagcacgaccctgaaaggagcccagcggcttgctgccctgggcgatacagcttgggacttcgggtccattggcggagtgtttaatagcatcggcagagccgttcaccaggtgttcgggggagcgtttcgcaccctcttcggcgggatgtcttggattacacaaggactgatgggcgccctgcttctctggatgggggtcaacgctcgggatagatccatcgccctggcttttctggccaccggcggagtgctcgttttcctggcgacgaatgtgcatgcctga

SEQ ID NO: 2113 - RNA, 2043 nt, synthetic construct
  misc_feature 1..2043: note = derived and/or modified CDS sequence (opt5) from DENV-4 Consensus__SSopt-prMEdelstem_TM,(H261N)-JEV
  source 1..2043: mol_type = other RNA
atgaagcggaaaaagagcaccatcacactgctctgcctgattcccacggtgatggccttccacctttccaccagagacggcgagcctctgatgatcgtcgctaaacatgaacgcgggagaccgctcctgtttaagacaaccgagggaattaacaaatgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagcggcgcagagaaaagcggtccgtcgcgctcacaccccactctggcatggggctggagacccgcgctgaaacgtggatgagctccgagggagcctggaaacatgcccaaagagtggagtcttggatccttcggaatcctggcttcgctctgctcgccggctttatggcttacatgatcgggcagacaggcattcagcgcaccgttttctttgtgctgatgatgcttgtcgcccccagctatggaatgagatgtgtgggggttggaaaccgggatttcgtggaaggcgtctccgggggagcgtgggtggacctggtgctcgagcacggcggctgcgtcacaaccatggcccaggggaagcctaccctggattttgaactgacaaaaacgaccgctaaggaggttgccctcctgcgcacatactgtatcgaagctagcatttctaatatcaccacagccaccagatgcccgacgcaaggagagccctatcttaaagaggaacaggaccagcagtacatttgtcggcgcgatgtggtggacagaggctgggggaacggatgcggcctgttcgggaagggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctcggtcccccagcgtggaggtcaaacttcctgattacggagaactgaccctcgactgcgagcccagatctggcatcgacttcaacgagatgattctgatgaagatgaagaaaaagacatggctggtgcataaacagtggtttctcgatctgccgcttccttggaccgccggggctgacacgtccgaagttcactggaattacaaggagcgcatggtgaccttcaaggtcccccatgccaaacggcaggatgtgacagttctgggcagccaggaaggagccatgaactccgctctcgcgggcgccaccgaggtggactctggggatggaaatcacatgtttgctggccacctgaagtgtaaagtcagaatggaaaaacttcgcatcaaggggatgagctatacaatgtgctccggaaagttcagcattgacaaggagatggccgagacccaacatggcacgacagtggtgaaagttaagtacgaaggggccggcgctccttgtaaagtccccatcgagattcgggatgtgaacaaggaaaaagtggtcggaagagtgatctcttccacacccctggccgagaacaccaatagcgttaccaacatcgagctcgaacctccgttcggcgactcttatattgtgatcggggtcggaaatagcgcgctgaccctgcactggtttcgcaagggctccacactcgggaaggctttctctacgaccctgaaaggagcccagcggcttgccgctctgggcgatacagcctgggactttgggagcattggcggagtgttcaactccatcggcagagctgttcatcaggtgtttgggggagccttccgcaccctctttggcgggatgagctggattacacaaggactgatgggcgcgctgcttctctggatgggggtcaatgcccgggatagatctatcgctctggccttcctggctaccggcggagtgctcgtttttctggccacgaacgtgcacgcgtga

SEQ ID NO: 2114 - RNA, 2043 nt, synthetic construct
  misc_feature 1..2043: note = derived and/or modified CDS sequence (opt5) from DENV-4 Consensus__SSopt-prMEdelstem_TM,(R188L,A267T)-JEV
  source 1..2043: mol_type = other RNA
atgaagcggaaaaagagcaccatcacactgctctgcctgattcccacggtgatggccttccacctttccaccagagacggcgagcctctgatgatcgtcgctaaacatgaacgcgggagaccgctcctgtttaagacaaccgagggaattaacaaatgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagcggcgcagagaaaagcggtccgtcgcgctcacaccccactctggcatggggctggagacccgcgctgaaacgtggatgagctccgagggagcctggaaacatgcccaaagagtggagtcttggatccttcggaatcctggcttcgctctgctcgccggctttatggcttacatgatcgggcagacaggcattcagcgcaccgttttctttgtgctgatgatgcttgtcgcccccagctatggaatgagatgtgtgggggttggaaaccgggatttcgtggaaggcgtctccgggggagcgtgggtggacctggtgctcgagcacggcggctgcgtcacaaccatggcccaggggaagcctaccctggattttgaactgacaaaaacgaccgctaaggaggttgccctcctgcgcacatactgtatcgaagctagcatttctaatatcaccacagccaccagatgcccgacgcaaggagagccctatcttaaagaggaacaggaccagcagtacatttgtcggcgcgatgtggtggacagaggctgggggaacggatgcggcctgttcgggaagggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctcggtcccccagcgtggaggtcaaacttcctgattacggagaactgaccctcgactgcgagcccctgtctggcatcgacttcaacgagatgattctgatgaagatgaagaaaaagacatggctcgtgcataaacagtggtttctggatcttccgctgccttggaccgccggggctgacacgtccgaagttcactggaattacaaggagagaatggtgaccttcaaggtcccccatgccaaacgccaggatgtgacagttctcggcagccaggaaggagccatgcactccgctctggcgggcaccacagaggtggactctggggatggaaaccacatgtttgccggccatcttaagtgtaaagtccggatggaaaagctgagaatcaaagggatgagctataccatgtgctccggaaagttcagcattgacaaggagatggctgagacgcaacacggcacaaccgtggtgaaagttaagtacgaaggggccggcgccccttgtaaagtccccatcgagattcgcgatgtgaataaggaaaaagtggtcggacgggtgatctcttccacacccctcgctgagaacaccaacagcgttaccaatatcgagctggaacctccgttcggcgactcttatattgtgatcggggtcggaaacagcgccctgacactccattggtttagaaagggctccacgctggggaaggcgttctctaccacacttaaaggagctcagcgcctggccgccctcggcgataccgcttgggactttgggagcattggcggagtgttcaattccatcggccgggccgttcaccaggtgtttgggggagctttcagaacactgtttggcgggatgagctggattacccaaggactgatgggcgcccttctcctgtggatgggggtcaacgcgcgcgatcggtctatcgccctggctttcctcgccacgggcggagtgctggtttttcttgctacaaatgtgcatgcctga

SEQ ID NO: 2115 - RNA, 300 nt, synthetic construct
  misc_feature 1..300: note = derived and/or modified CDS sequence (opt5) from DENV-3 Consensus__C
  source 1..300: mol_type = other RNA
atgaacaatcagagaaagaaaaccggcaagcccagcatcaacatgctgaaacgggtgcgcaatagagtctccacagggtctcaactcgccaagcggttcagcaaaggactgcttaacggccaggggcctatgaagctggttatggcttttattgccttcctccgctttctggcgatcccgcccacggctggagtgcttgccagatggggcaccttcaagaaatccggggccattaaggtgctgaaaggatttaagaaagagatctctaatatgctcagcattatcaacaagcggaagaaa

SEQ ID NO: 2116 - RNA, 342 nt, synthetic construct
  misc_feature 1..342: note = derived and/or modified CDS sequence (opt5) from DENV-3 Consensus__C-SSc
  source 1..342: mol_type = other RNA
atgaacaatcagagaaagaaaaccggcaagcccagcatcaacatgctgaaacgggtgcgcaatagagtctccacagggtctcaactcgccaagcggttcagcaaaggactgcttaacggccaggggcctatgaagctggttatggcttttattgccttcctccgctttctggcgatcccgcccacggctggagtgcttgccagatggggcaccttcaagaaatccggggccattaaggtgctgaaaggatttaagaaagagatctctaatatgctcagcattatcaacaagcggaagaaaacatccctgtgcctgatgatgatcctccctgctgccctggct

SEQ ID NO: 2117 - RNA, 273 nt, synthetic construct
  misc_feature 1..273: note = derived and/or modified CDS sequence (opt5) from DENV-3 Consensus__pr
  source 1..273: mol_type = other RNA
ttccacctgaccagcagagacggcgagccccggatgatcgtggggaagaacgaacgcggaaaatccctcctgtttaagacagcctctggcattaatatgtgcacgcttatcgctatggatctgggggagatgtgtgacgataccgtcacatacaaatgccctcatattaccgaagttgagccggaagacatcgattgttggtgcaacctcacaagcacctgggtgacatatggaacctgtaatcaggccggcgagcacagacgggacaagcgc

SEQ ID NO: 2118 - RNA, 225 nt, synthetic construct
  misc_feature 1..225: note = derived and/or modified CDS sequence (opt5) from DENV-3 Consensus__M
  source 1..225: mol_type = other RNA
agcgtggccctggctccccacgtcggcatggggctcgacaccagaacacagacgtggatgtccgccgagggagcgtggcggcaagttgaaaaggtggagacctgggctctgcgccatcctggcttcacaatccttgccctgtttctcgcccactacattgggacctctctgacacagaaagtggtcatcttcattcttctgatgctcgtgaccccgagcatgaca

SEQ ID NO: 2119 - RNA, 498 nt, synthetic construct
  misc_feature 1..498: note = derived and/or modified CDS sequence (opt5) from DENV-3 Consensus__prM
  source 1..498: mol_type = other RNA
ttccacctgaccagcagagacggcgagccccggatgatcgtggggaagaacgaacgcggaaaatccctcctgtttaagacagcctctggcattaatatgtgcacgcttatcgctatggatctgggggagatgtgtgacgataccgtcacatacaaatgccctcatattaccgaagttgagccggaagacatcgattgttggtgcaacctcacaagcacctgggtgacatatggaacctgtaatcaggccggcgagcacagacgggacaagcgctccgtggcgctggctccccatgtcgggatgggacttgatacgagaacccaaacatggatgtctgccgagggcgcctggcgccaggtggaaaaagttgagacctgggctctgcggcaccctggcttcacaattctcgccctgtttctggctcattacatcgggaccagcctcacgcagaaggtggtcatcttcattctgcttatgctggtgacaccctccatgacc

SEQ ID NO: 2120 - RNA, 1479 nt, synthetic construct
  misc_feature 1..1479: note = derived and/or modified CDS sequence (opt5) from DENV-3 Consensus__E
  source 1..1479: mol_type = other RNA
atgagatgcgtgggcgtcgggaaccgggacttcgttgagggactgagcggcgccacctgggtggatgtggtcctcgaacacgggggatgtgtgacaacgatggctaagaataaacccaccctggacatcgagcttcagaagacagaagccacccaactggcgacactccgcaaactgtgcattgagggcaagatcaccaacattacaaccgattccagatgtcctacgcagggggaagctacccttccggaggagcaggaccagaattacgtttgcaaacatacatatgtggatcggggatggggcaacggctgtgggctgtttggaaagggctctctcgtgacctgcgccaagttccaatgtctggaacccatcgaggggaaagtcgttcagtacgaaaatctgaagtatacagtgattatcaccgtccacacgggagaccagcatcaggtgggcaacgagacacaaggggtgaccgccgagatcacacctcaggctagcaccaccgaagccattctccccgagtacggaacactgggccttgaatgctcccctcgcacgggcctggattttaatgagatgatcctcctgaccatgaaaaacaaggcttggatggtccacagacagtggttctttgaccttcccctgccttggacatctggggccaccacagaaaccccgacgtggaatcggaaagagctcctggttacattcaagaacgcgcatgccaagaaacaggaggtggtggtcctgggaagccaagaaggcgctatgcacaccgccctcaccggggctacagagattcaaaattccggaggcacctctatctttgccgggcacctgaagtgtcgccttaaaatggataagctggaactcaaaggaatgagctatgcgatgtgcacaaacacgttcgtgctgaagaaagaggtttccgaaacccagcatggcacaattcttatcaaggtggagtacaagggcgaggacgtcccctgtaaaattccttttagcaccgaagatgggcagggaaaggcccacaatggcagactgatcacagctaaccccgtggttaccaaaaaggaggaacctgtgaatatcgaggccgaacccccgttcggggagtctaacattgtcatcggaattggcgacaacgctctcaaaatcaattggtataagaaggggtccagcattggcaaaatgtttgaggccacggcccggggagctcgcagaatggcgatcctgggcgataccgcctgggacttcgggtctgtgggaggcgtcctgaactccctcgggaagatggtgcatcagatctttggaagcgcttacacagccctgttctctggcgtttcctgggtgatgaaaattgggatcggcgtccttctgacctggattggactcaatagcaagaacacatccatgtctttcagctgcatcgccattggcatcatcaccctgtaccttggggctgtggttcaggcc

SEQ ID NO: 2121 - RNA, 1977 nt, synthetic construct
  misc_feature 1..1977: note = derived and/or modified CDS sequence (opt5) from DENV-3 Consensus__prME
  source 1..1977: mol_type = other RNA
ttccacctgaccagcagagacggcgagccccggatgatcgtggggaagaacgaacgcggaaaatccctcctgtttaagacagcctctggcattaatatgtgcacgcttatcgctatggatctgggggagatgtgtgacgataccgtcacatacaaatgccctcatattaccgaagttgagccggaagacatcgattgttggtgcaacctcacaagcacctgggtgacatatggaacctgtaatcaggccggcgagcacagacgggacaagcgctccgtggcgctggctccccatgtcgggatgggacttgatacgagaacccaaacatggatgtctgccgagggcgcctggcgccaggtggaaaaagttgagacctgggctctgcggcaccctggcttcacaattctcgccctgtttctggctcattacatcgggaccagcctcacgcagaaggtggtcatcttcattctgcttatgctggtgacaccctccatgaccatgagatgcgttggagtgggcaaccgggactttgtcgaagggctctctggagccacatgggtggatgtggtcctggagcacggcgggtgtgttaccaccatggcgaagaataaacctacacttgacatcgagctgcagaagacggaagccacccaactcgctacactgcgcaaactgtgcattgagggaaagatcaccaacattacaaccgatagcagatgtcccacgcagggcgaagccacactccctgaggaacaggaccagaattatgtgtgcaaacacacctacgtggatcggggctgggggaacggatgtggcctgttcgggaagggatcccttgtgacctgcgctaagtttcaatgcctggagccgatcgagggcaaagtggttcagtatgaaaatctcaagtacacagtgattatcaccgtccatacaggggaccagcaccaggtgggaaacgagacgcaaggcgttaccgccgaaatcacaccccaggcgagcaccacagaggccattctgcctgaatatggcacccttgggctggagtgttctccccgcacgggactcgacttcaatgagatgatcctgctgaccatgaaaaacaaggcttggatggtgcatagacagtggtttttcgatctccctctgccctggacatccggcgccaccacagaaaccccgacgtggaatcggaaagagcttctggtcacatttaagaacgctcacgccaaaaagcaagaagtggtcgtgctcgggagccaggagggagccatgcacaccgctctgacaggcgcgaccgaaattcaaaattctgggggcacctccatcttcgccggacatcttaagtgccgcctgaaaatggacaagctcgagctgaaaggcatgagctacgctatgtgtacaaacacgtttgttctgaagaaagaggtgtctgaaacccagcacgggacaattctcatcaaggtcgagtacaagggagaagatgtgccttgcaaaatccccttctccaccgaggacggccaggggaaggcccataacggaagactgattacagccaatcctgttgtgaccaaaaaggaggaacccgtcaacatcgaggctgaaccccctttcggcgagagcaatattgtgatcgggattggcgataacgcccttaaaatcaattggtataagaagggatcctctatcggcaaaatgtttgaagcgacggctagaggggcccggcgcatggccattctgggagacacagcttgggatttcggcagcgtcgggggagttctcaactccctgggcaagatggtccaccagatctttgggagcgcctacaccgctctgttctctggcgtgtcctgggtgatgaaaattggaatcggcgtccttctcacctggattgggctgaatagcaagaacacatctatgagcttttcctgtatcgccattggaatcatcaccctgtatctcggcgcggtggttcaggcc

SEQ ID NO: 2122 - RNA, 2019 nt, synthetic construct
  misc_feature 1..2019: note = derived and/or modified CDS sequence (opt5) from DENV-3 Consensus__SSc-prME
  source 1..2019: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcgccaggtggaaaaagttgagacatgggccctccggcaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaggggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcccggcgcatggctatccttggagacaccgcctgggatttcggctccgttgggggagtgctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggct

SEQ ID NO: 2123 - RNA, 1056 nt, synthetic construct
  misc_feature 1..1056: note = derived and/or modified CDS sequence (opt5) from DENV-3 Consensus__NS1
  source 1..1056: mol_type = other RNA
gacatgggctgcgtgatcaactggaaggggaaagagctgaagtgtggaagcggcattttcgtcaccaatgaagttcacacatggacggagcagtacaaatttcaagccgattcccccaagagactcgctaccgccatcgcgggggcttgggaaaacggagtgtgcggcattcggtctacaacccgcatggagaatctgctttggaaacagatcgccaacgaactgaattatattctctgggagaacaatatcaagctgacagtggtcgtgggggacatcattggagttcttgagcagggcaagagaaccctgacacctcagccgatggaactcaaatacagctggaagacctggggcaaagccaagatcgtgacggctgagacccaaaactcctctttcattatcgatgggcccaatacacctgaatgtcccagcgtctcccgggcctggaacgtgtgggaggttgaggactatggatttggcgtgttcaccacaaatatttggctgaaactgcgcgaagtctacacccagctctgcgatcatagactgatgtctgctgccgtgaaggacgagcgggcggtgcacgccgatatggggtattggatcgaaagccagaagaacggatcctggaaacttgagaaggctagcctgattgaagtcaaaacgtgtacatggcctaagtctcataccctctggtccaatggcgttctggagagcgacatgatcatccccaaatctcttgccgggcctatttcccagcacaaccatcgcccgggataccacacacaaaccgctggcccctggcacctgggcaagctcgagctggattttaattattgcgaagggaccacagtggtgatcacggagaactgtggaaccagaggccctagcctgcggacaaccacagtctctgggaaactcattcatgaatggtgctgtcgctcctgcaccctgccccctcttagatacatgggagaggacggctgttggtacgggatggaaatccggcccattagcgagaaggaggaaaacatggtgaagtccctggtttctgcc

SEQ ID NO: 2124 - RNA, 1857 nt, synthetic construct
  misc_feature 1..1857: note = derived and/or modified CDS sequence (opt5) from DENV-3 Consensus__NS3
  source 1..1857: mol_type = other RNA
agcggcgtgctgtgggacgtcccctcccctccggagacccagaaggccgaactcgaggaaggggtttacagaatcaaacaacagggaattttcggcaagacacaggtgggggtgggagtccagaaagagggcgtgtttcacacgatgtggcatgttacccgcggggctgtgctgacatataacggaaagcggcttgaacccaattgggcctctgtcaaaaaggatctgatcagctacggcggcgggtggagactctccgcgcaatggcagaagggagaggaggtgcaggttattgctgtggaacctggcaaaaaccccaagaatttccagaccatgcctgggacatttcaaaccacaaccggagagatcggcgccattgccctggacttcaaacccgggacgtctggaagccctatcatcaaccgggaaggcaaggtcgtgggcctttatgggaatggagtggtcaccaaaaacggcgggtacgtttccggaattgctcagacaaatgccgagccggatggccccacccctgagctggaagaggaaatgtttaagaagcgcaacctcacaatcatggacctgcaccccgggtctggaaaaaccagaaagtatctgcctgctattgtgcgggaggccatcaaacgcagactccggacgctgattcttgcgcccacacgcgtggtcgccgctgaaatggaggaggccctgaagggcctcccgatcagataccagaccacagctaccaaaagcgaacataccggccgggagattgtggatctgatgtgccacgccacattcacgatgcgccttctgtcccctgttagagtgcccaattataacctcatcatcatggacgaagcgcattttaccgatcctgccagcattgctgcccgggggtacatctctacacgcgtcggaatgggcgaggctgccgccattttcatgaccgctacacctcccgggaccgcggacgcctttccccagtccaatgctccgatccaagatgaagagagagacattcccgagcggagctggaactctggaaatgaatggatcacggatttcgccggcaagacagtgtggtttgttccttccatcaaagccgggaacgacattgctaattgtctgagaaagaacggcaagaaagtgatccagctgagccgcaagaccttcgataccgagtaccagaaaacaaagctcaacgactgggactttgtcgtgaccacagatatttctgaaatgggagccaatttcaaagcggaccgggtcatcgatcccagacgctgcctgaagcctgtgattcttacggacggccccgagcgggttatcctggctgggccgatgcctgtgaccgccgcctccgctgcccaaagacgcggacgggtcggcagaaacccccagaaggaaaatgatcagtatatcttcacagggcagcctctcaacaatgacgaggatcacgctcactggaccgaggccaaaatgctgcttgacaacattaatacacccgaaggaatcattcctgcgctgtttgagcccgaacgcgaaaagagcgccgctatcgatggcgagtaccggctcaaaggggagtccagaaagaccttcgtggagctgatgcgccggggcgacctgccggtttggctcgcccataaagtggcttctgaaggaattaagtatacggatagaaagtggtgttttgacggccaacggaacaatcagatcctggaggaaaacatggacgtcgagatttggaccaaagagggggaaaagaaaaagctgcgccctagatggcttgatgcccggacatacagcgaccccctcgcgctgaaagagttcaaggaatttgccgctggaagaaag

SEQ ID NO: 2125 - RNA, 2319 nt, synthetic construct
  misc_feature 1..2319: note = derived and/or modified CDS sequence (opt5) from DENV-3 Consensus__C-prME
  source 1..2319: mol_type = other RNA
atgaacaatcagagaaagaaaaccggcaagcccagcatcaacatgctgaaacgggtgcgcaatagagtctccacagggtctcaactcgccaagcggttcagcaaaggactgcttaacggccaggggcctatgaagctggttatggcttttattgccttcctccgctttctggcgatcccgcccacggctggagtgcttgccagatggggcaccttcaagaaatccggggccattaaggtgctgaaaggatttaagaaagagatctctaatatgctcagcattatcaacaagcggaagaaaacatccctgtgcctgatgatgatcctccctgctgccctggctttccaccttacctctcgcgacggcgaacccagaatgattgtcggcaagaatgagcgggggaaaagcctgctctttaagacagcctccggaatcaacatgtgtaccctgattgcgatggatcttggcgaaatgtgcgacgatacagtgacctacaaatgtcctcatatcacggaggttgaacccgaggacattgattgctggtgtaatctgaccagcacatgggtgacctatgggacatgcaaccaggccggagagcaccgcagagacaagcggtctgtcgctctcgcccctcatgtgggcatggggctggatacccgcacgcagacatggatgtccgctgaaggagcctggagacaagttgagaaagtggaaacctgggcgctgcggcacccgggcttcacaatcctcgccctgtttcttgctcattacattggcaccagcctgacccagaaggtcgtgatcttcatcctcctgatgcttgtgacaccctctatgacgatgcgctgtgtcggggttggaaatagagactttgtggagggcctgtccggggccacctgggtggatgtcgtgctcgagcacggaggctgcgttacaaccatggctaagaacaaacctacactggacattgaactgcagaagaccgaggccacgcagctcgccacactgcggaaactttgtatcgaagggaagattaccaatatcaccacagatagcagatgccccacccaaggagaggctacactgcctgaagaacaggaccagaactatgtgtgtaaacacacgtacgtcgatcgcggctggggcaatgggtgcggactcttcggcaaggggtctctggtgacctgcgcgaagtttcagtgtcttgagcccattgaaggaaaagttgtgcaatatgagaacctgaagtacacagtcatcatcaccgtgcatacaggcgaccagcaccaggtcgggaacgaaacccaaggcgtgacggccgagattaccccgcaggcttccacaaccgaagccatcctccctgagtatggaacactgggcctggagtgcagcccccggaccgggctcgacttcaatgaaatgattctgcttacgatgaaaaacaaggcctggatggttcatagacagtggttctttgatctgcctctcccctggacatccggagctaccacagagacccccacctggaatcgcaaagaactgctggtgacattcaagaacgcccacgcgaagaaacaggaggtcgtggttcttggctctcaagaaggggctatgcacacggccctcaccggagccacagagatccagaatagcggcgggacctccatttttgctggccatctgaagtgtcggctgaaaatggacaagctcgagctgaaaggaatgagctacgccatgtgcacaaacaccttcgtgcttaagaaggaagtctctgagacgcagcacggcacaatcctgatcaaagtggaatacaagggggaggatgtgccttgtaaaattccgttttccaccgaggacggacagggcaaggctcataatgggagactcatcaccgccaaccccgttgtcaccaaaaaggaggagcctgtgaatattgaagcggagccccctttcggagaaagcaacatcgtgattggcatcggggataatgccctgaaaattaactggtataagaagggctctagcatcggaaaaatgtttgaggctacagcccgcggcgctcggagaatggccatcctgggggacacagcgtgggatttcggatccgtcggcggggtgcttaattctctcggaaagatggttcaccaaatttttggcagcgcctacacggctctgttctccggggtgagctgggtcatgaaaatcggcattggagtgctgctcacctggatcggcctgaactctaagaatacatccatgagcttttcttgcattgccatcgggatcattaccctttatctgggagctgttgtgcaggcc

SEQ ID NO: 2126 - RNA, 45 nt, synthetic construct
  misc_feature 1..45: note = derived and/or modified CDS sequence (opt5) from DENV-3 Consensus__SSc
  source 1..45: mol_type = other RNA
atgaccagcctgtgcctcatgatgatcctgcccgccgctcttgcc

SEQ ID NO: 2127 - RNA, 57 nt, synthetic construct
  misc_feature 1..57: note = derived and/or modified CDS sequence (opt5) from DENV-3 Consensus__SSopt
  source 1..57: mol_type = other RNA
atgaagagaaagaaaaccagcctgtgcctcatgatgatcctgcccgccgctcttgcc

SEQ ID NO: 2128 - RNA, 57 nt, synthetic construct
  misc_feature 1..57: note = derived and/or modified CDS sequence (opt5) from DENV-3 Consensus__SSm
  source 1..57: mol_type = other RNA
atgacccagaaggtggtcatcttcattctgctcatgctggttacacccagcatgacg

SEQ ID NO: 2129 - RNA, 1482 nt, synthetic construct
  misc_feature 1..1482: note = derived and/or modified CDS sequence (opt5) from DENV-3 Consensus__E
  source 1..1482: mol_type = other RNA
atgagatgcgtgggcgtcgggaaccgggacttcgttgagggactgagcggcgccacctgggtggatgtggtcctcgaacacgggggatgtgtgacaacgatggctaagaataaacccaccctggacatcgagcttcagaagacagaagccacccaactggcgacactccgcaaactgtgcattgagggcaagatcaccaacattacaaccgattccagatgtcctacgcagggggaagctacccttccggaggagcaggaccagaattacgtttgcaaacatacatatgtggatcggggatggggcaacggctgtgggctgtttggaaagggctctctcgtgacctgcgccaagttccaatgtctggaacccatcgaggggaaagtcgttcagtacgaaaatctgaagtatacagtgattatcaccgtccacacgggagaccagcatcaggtgggcaacgagacacaaggggtgaccgccgagatcacacctcaggctagcaccaccgaagccattctccccgagtacggaacactgggccttgaatgctcccctcgcacgggcctggattttaatgagatgatcctcctgaccatgaaaaacaaggcttggatggtccacagacagtggttctttgaccttcccctgccttggacatctggggccaccacagaaaccccgacgtggaatcggaaagagctcctggttacattcaagaacgcgcatgccaagaaacaggaggtggtggtcctgggaagccaagaaggcgctatgcacaccgccctcaccggggctacagagattcaaaattccggaggcacctctatctttgccgggcacctgaagtgtcgccttaaaatggataagctggaactcaaaggaatgagctatgcgatgtgcacaaacacgttcgtgctgaagaaagaggtttccgaaacccagcatggcacaattcttatcaaggtggagtacaagggcgaggacgtcccctgtaaaattccttttagcaccgaagatgggcagggaaaggcccacaatggcagactgatcacagctaaccccgtggttaccaaaaaggaggaacctgtgaatatcgaggccgaacccccgttcggggagtctaacattgtcatcggaattggcgacaacgctctcaaaatcaattggtataagaaggggtccagcattggcaaaatgtttgaggccacggcccggggagctcgcagaatggcgatcctgggcgataccgcctgggacttcgggtctgtgggaggcgtcctgaactccctcgggaagatggtgcatcagatctttggaagcgcttacacagccctgttctctggcgtttcctgggtgatgaaaattgggatcggcgtccttctgacctggattggactcaatagcaagaacacatccatgtctttcagctgcatcgccattggcatcatcaccctgtaccttggggctgtggttcaggcctga

SEQ ID NO: 2130 - RNA, 1176 nt, synthetic construct
  misc_feature 1..1176: note = derived and/or modified CDS sequence (opt5) from DENV-3 Consensus__EdelTM-variant (aa1-392)
  source 1..1176: mol_type = other RNA
atgagatgcgtgggcgtcgggaaccgggacttcgttgagggactgagcggcgccacctgggtggatgtggtcctcgaacacgggggatgtgtgacaacgatggctaagaataaacccaccctggacatcgagcttcagaagacagaagccacccaactggcgacactccgcaaactgtgcattgagggcaagatcaccaacattacaaccgattccagatgtcctacgcagggggaagctacccttccggaggagcaggaccagaattacgtttgcaaacatacatatgtggatcggggatggggcaacggctgtgggctgtttggaaagggctctctcgtgacctgcgccaagttccaatgtctggaacccatcgaggggaaagtcgttcagtacgaaaatctgaagtatacagtgattatcaccgtccacacgggagaccagcatcaggtgggcaacgagacacaaggggtgaccgccgagatcacacctcaggctagcaccaccgaagccattctccccgagtacggaacactgggccttgaatgctcccctcgcacgggcctggattttaatgagatgatcctcctgaccatgaaaaacaaggcttggatggtccacagacagtggttctttgaccttcccctgccttggacatctggggccaccacagaaaccccgacgtggaatcggaaagagctcctggttacattcaagaacgcgcatgccaagaaacaggaggtggtggtcctgggaagccaagaaggcgctatgcacaccgccctcaccggggctacagagattcaaaattccggaggcacctctatctttgccgggcacctgaagtgtcgccttaaaatggataagctggaactcaaaggaatgagctatgcgatgtgcacaaacacgttcgtgctgaagaaagaggtttccgaaacccagcatggcacaattcttatcaaggtggagtacaagggcgaggacgtcccctgtaaaattccttttagcaccgaagatgggcagggaaaggcccacaatggcagactgatcacagctaaccccgtggttaccaaaaaggaggaacctgtgaatatcgaggccgaacccccgttcggggagtctaacattgtcatcggaattggcgacaacgctctcaaaatcaattggtataagaag

SEQ ID NO: 2131 - RNA, 1269 nt, synthetic construct
  misc_feature 1..1269: note = derived and/or modified CDS sequence (opt5) from DENV-3 Consensus__EdelTM-variant (aa1-422)
  source 1..1269: mol_type = other RNA
atgagatgcgtgggcgtcgggaaccgggacttcgttgagggactgagcggcgccacctgggtggatgtggtcctcgaacacgggggatgtgtgacaacgatggctaagaataaacccaccctggacatcgagcttcagaagacagaagccacccaactggcgacactccgcaaactgtgcattgagggcaagatcaccaacattacaaccgattccagatgtcctacgcagggggaagctacccttccggaggagcaggaccagaattacgtttgcaaacatacatatgtggatcggggatggggcaacggctgtgggctgtttggaaagggctctctcgtgacctgcgccaagttccaatgtctggaacccatcgaggggaaagtcgttcagtacgaaaatctgaagtatacagtgattatcaccgtccacacgggagaccagcatcaggtgggcaacgagacacaaggggtgaccgccgagatcacacctcaggctagcaccaccgaagccattctccccgagtacggaacactgggccttgaatgctcccctcgcacgggcctggattttaatgagatgatcctcctgaccatgaaaaacaaggcttggatggtccacagacagtggttctttgaccttcccctgccttggacatctggggccaccacagaaaccccgacgtggaatcggaaagagctcctggttacattcaagaacgcgcatgccaagaaacaggaggtggtggtcctgggaagccaagaaggcgctatgcacaccgccctcaccggggctacagagattcaaaattccggaggcacctctatctttgccgggcacctgaagtgtcgccttaaaatggataagctggaactcaaaggaatgagctatgcgatgtgcacaaacacgttcgtgctgaagaaagaggtttccgaaacccagcatggcacaattcttatcaaggtggagtacaagggcgaggacgtcccctgtaaaattccttttagcaccgaagatgggcagggaaaggcccacaatggcagactgatcacagctaaccccgtggttaccaaaaaggaggaacctgtgaatatcgaggccgaacccccgttcggggagtctaacattgtcatcggaattggcgacaacgctctcaaaatcaattggtataagaaggggtccagcattggcaaaatgtttgaggccacggcccggggagctcgcagaatggcgatcctgggcgataccgcctgggacttcgggtcttga

SEQ ID NO: 2132 - RNA, 1260 nt, synthetic construct
  misc_feature 1..1260: note = derived and/or modified CDS sequence (opt5) from DENV-3 Consensus__EdelTM-variant (aa1-419)
  source 1..1260: mol_type = other RNA
atgagatgcgtgggcgtcgggaaccgggacttcgttgagggactgagcggcgccacctgggtggatgtggtcctcgaacacgggggatgtgtgacaacgatggctaagaataaacccaccctggacatcgagcttcagaagacagaagccacccaactggcgacactccgcaaactgtgcattgagggcaagatcaccaacattacaaccgattccagatgtcctacgcagggggaagctacccttccggaggagcaggaccagaattacgtttgcaaacatacatatgtggatcggggatggggcaacggctgtgggctgtttggaaagggctctctcgtgacctgcgccaagttccaatgtctggaacccatcgaggggaaagtcgttcagtacgaaaatctgaagtatacagtgattatcaccgtccacacgggagaccagcatcaggtgggcaacgagacacaaggggtgaccgccgagatcacacctcaggctagcaccaccgaagccattctccccgagtacggaacactgggccttgaatgctcccctcgcacgggcctggattttaatgagatgatcctcctgaccatgaaaaacaaggcttggatggtccacagacagtggttctttgaccttcccctgccttggacatctggggccaccacagaaaccccgacgtggaatcggaaagagctcctggttacattcaagaacgcgcatgccaagaaacaggaggtggtggtcctgggaagccaagaaggcgctatgcacaccgccctcaccggggctacagagattcaaaattccggaggcacctctatctttgccgggcacctgaagtgtcgccttaaaatggataagctggaactcaaaggaatgagctatgcgatgtgcacaaacacgttcgtgctgaagaaagaggtttccgaaacccagcatggcacaattcttatcaaggtggagtacaagggcgaggacgtcccctgtaaaattccttttagcaccgaagatgggcagggaaaggcccacaatggcagactgatcacagctaaccccgtggttaccaaaaaggaggaacctgtgaatatcgaggccgaacccccgttcggggagtctaacattgtcatcggaattggcgacaacgctctcaaaatcaattggtataagaaggggtccagcattggcaaaatgtttgaggccacggcccggggagctcgcagaatggcgatcctgggcgataccgcctgggactga

SEQ ID NO: 2133 - RNA, 1155 nt, synthetic construct
  misc_feature 1..1155: note = derived and/or modified CDS sequence (opt5) from DENV-3 Consensus__Edelaa101-107
  source 1..1155: mol_type = other RNA
atgagatgcgtgggcgtcgggaaccgggacttcgttgagggactgagcggcgccacctgggtggatgtggtcctcgaacacgggggatgtgtgacaacgatggctaagaataaacccaccctggacatcgagcttcagaagacagaagccacccaactggcgacactccgcaaactgtgcattgagggcaagatcaccaacattacaaccgattccagatgtcctacgcagggggaagctacccttccggaggagcaggaccagaattacgtttgcaaacatacatatgtggatcggggatttggcaagggctctctggtcacctgtgccaagttccaatgcctcgaacccatcgaggggaaagtggttcagtacgaaaacctgaagtatacagtgattatcaccgtccacacgggagaccagcatcaggtgggcaatgagacacaaggggtgaccgccgagatcacacctcaggctagcaccaccgaagccattctgcccgagtacggaacactcggcctggaatgttcccctcgcacggggcttgattttaacgagatgatcctgctcaccatgaaaaataaggcttggatggtccacagacagtggttctttgacctgccccttccttggacatctggagccaccacagaaaccccgacgtggaaccggaaagagctgctcgttacattcaagaatgcgcatgccaagaaacaggaggtggtggtcctgggcagccaagaaggcgctatgcacaccgccctgaccggggctacagagattcagaactccggaggcacctctatctttgccgggcacctcaagtgccgcctgaaaatggataaacttgaactgaagggaatgagctatgcgatgtgtacaaatacgttcgtgctcaagaaagaggtttccgaaacccagcatggcacaattctgatcaaggtggagtacaagggggaggacgtcccctgcaaaattccttttagcaccgaagatggacaaggcaaggcccacaacggcagacttatcacagctaatcccgtggttaccaaaaaggaggaacctgtgaacatcgaggccgaacccccgttcggggagtctaatattgtcatcggaattggcgacaacgctctgaaaatcaactggtataagaag

SEQ ID NO: 2134 - RNA, 1173 nt, synthetic construct
  misc_feature 1..1173: note = derived and/or modified CDS sequence (opt5) from DENV-3 Consensus__EdelTM-variant (aa1-391)
  source 1..1173: mol_type = other RNA
atgagatgcgtgggcgtcgggaaccgggacttcgttgagggactgagcggcgccacctgggtggatgtggtcctcgaacacgggggatgtgtgacaacgatggctaagaataaacccaccctggacatcgagcttcagaagacagaagccacccaactggcgacactccgcaaactgtgcattgagggcaagatcaccaacattacaaccgattccagatgtcctacgcagggggaagctacccttccggaggagcaggaccagaattacgtttgcaaacatacatatgtggatcggggatggggcaacggctgtgggctgtttggaaagggctctctcgtgacctgcgccaagttccaatgtctggaacccatcgaggggaaagtcgttcagtacgaaaatctgaagtatacagtgattatcaccgtccacacgggagaccagcatcaggtgggcaacgagacacaaggggtgaccgccgagatcacacctcaggctagcaccaccgaagccattctccccgagtacggaacactgggccttgaatgctcccctcgcacgggcctggattttaatgagatgatcctcctgaccatgaaaaacaaggcttggatggtccacagacagtggttctttgaccttcccctgccttggacatctggggccaccacagaaaccccgacgtggaatcggaaagagctcctggttacattcaagaacgcgcatgccaagaaacaggaggtggtggtcctgggaagccaagaaggcgctatgcacaccgccctcaccggggctacagagattcaaaattccggaggcacctctatctttgccgggcacctgaagtgtcgccttaaaatggataagctggaactcaaaggaatgagctatgcgatgtgcacaaacacgttcgtgctgaagaaagaggtttccgaaacccagcatggcacaattcttatcaaggtggagtacaagggcgaggacgtcccctgtaaaattccttttagcaccgaagatgggcagggaaaggcccacaatggcagactgatcacagctaaccccgtggttaccaaaaaggaggaacctgtgaatatcgaggccgaacccccgttcggggagtctaacattgtcatcggaattggcgacaacgctctcaaaatcaattggtataag

SEQ ID NO: 2135 - RNA, 2025 nt, synthetic construct
  misc_feature 1..2025: note = derived and/or modified CDS sequence (opt5) from DENV-3 Consensus__SSc-prME
  source 1..2025: mol_type = other RNA
atgaccagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcgccaggtggaaaaagttgagacatgggccctccggcaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaggggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcccggcgcatggctatccttggagacaccgcctgggatttcggctccgttgggggagtgctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggcttga

SEQ ID NO: 2136 - RNA, 2025 nt, synthetic construct
  misc_feature 1..2025: note = derived and/or modified CDS sequence (opt5) from DENV-3 Consensus__SSc-prME(F108S)
  source 1..2025: mol_type = other RNA
atgaccagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcgccaggtggaaaaagttgagacatgggccctccggcaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgagcgggaagggatctcttgtcacatgcgccaagttccaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctccacaaccgaggctatcctgcccgaatatggcacgctggggctcgagtgcagccctcgcaccggactggactttaatgagatgattcttctgacaatgaaaaacaaggcctggatggtgcatagacagtggttctttgatctccccctgccgtggacctctggcgccacaaccgaaacgcctacatggaatcggaaagagcttctggtcaccttcaagaacgctcacgcgaaaaagcaagaagtggtcgtgctcgggtcccaggagggagccatgcacacagctctgaccggcgccaccgaaatccagaatagcgggggcacatctatttttgccggacatctgaagtgtcgcctcaaaatggacaagctggagcttaaaggcatgtcctacgctatgtgcacgaacaccttcgttctgaagaaagaggtgagcgaaacacagcacgggaccatcctcatcaaggtcgagtacaagggagaagatgtgccctgtaaaattcctttttccacagaggacggccaagggaaggcccataacggaagactgatcaccgcgaatcccgttgtgacgaaaaaggaggaacccgtcaacattgaggctgaacctccgttcggcgagtctaatatcgtgattgggatcggcgataacgccctgaaaatcaattggtataagaagggaagctccattggcaaaatgttcgaagccacagctagaggggcccggcgcatggctatccttggagacaccgcctgggattttggcagcgttgggggagtgctcaactctctgggcaagatggtccaccagattttcgggtccgcgtacaccgccctgtttagcggcgtgtcttgggtgatgaaaatcggaattggcgtcctcctgacatggatcgggcttaatagcaagaacacctccatgtctttcagctgcattgctatcggaatcattacactgtatctcggcgccgtggttcaggcttga

SEQ ID NO: 2137 - RNA, 2025 nt, synthetic construct
  misc_feature 1..2025: note = derived and/or modified CDS sequence (opt5) from DENV-3 Consensus__SSc-prME(R186L)
  source 1..2025: mol_type = other RNA
atgaccagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcgccaggtggaaaaagttgagacatgggccctccggcaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctctgaccggacttgacttcaatgagatgattctgctcacaatgaaaaacaaggcctggatggtgcatcgccagtggtttttcgatctgccccttccgtggaccagcggcgccacaaccgaaacgcctacatggaatagaaaagagctgctcgtcacctttaagaacgctcacgcgaaaaagcaagaagtggtcgtgctggggtctcaggagggagccatgcacacagctctgaccggcgccaccgaaatccaaaattccgggggcacaagcattttcgccggacatctcaagtgtcggctgaaaatggacaagctggagctgaaaggcatgtcttacgctatgtgcacgaacacctttgttctcaagaaagaggtgtccgaaacacagcacgggaccatcctgatcaaggtcgagtacaagggagaagatgtgccctgtaaaattcctttcagcacagaggacggccaggggaaggcccataacggacgcctgatcaccgcgaatcccgttgtgacgaaaaaggaggaacccgtcaacattgaggctgaacctccgttcggcgagtccaatatcgtgattgggatcggcgataacgcccttaaaatcaattggtataagaagggatctagcattggcaaaatgtttgaagccacagctagaggggcccggagaatggctatcctcggagacaccgcctgggatttcggctccgttgggggagtgctgaacagcctgggcaagatggtccaccagatttttgggtctgcgtacaccgccctcttctccggcgtgagctgggtgatgaaaatcggaattggcgtcctgcttacatggatcgggcttaattctaagaacaccagcatgtccttttcttgcattgctatcggaatcattacactctatctgggcgccgtggttcaggcttga

SEQ ID NO: 2138 - RNA, 2025 nt, synthetic construct
  misc_feature 1..2025: note = derived and/or modified CDS sequence (opt5) from DENV-3 Consensus__SSc-prME(A265T)
  source 1..2025: mol_type = other RNA
atgaccagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcgccaggtggaaaaagttgagacatgggccctccggcaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcaccacagaaatccaaaattccgggggcacgagcattttcgccggacatctgaagtgtcgcctcaaaatggacaagctggagcttaaaggcatgtcttacgccatgtgcaccaacacatttgttctgaagaaagaggtgtccgaaacccagcacgggacaatcctcatcaaggtcgagtacaagggagaagatgtgccctgtaaaattcctttcagcaccgaggacggccaggggaaggctcataacggaagactgatcacggccaatcccgttgtgaccaaaaaggaggaacccgtcaacattgaggcggaacctccgttcggcgagtccaatatcgtgattgggatcggcgataacgctctgaaaatcaattggtataagaagggatctagcattggcaaaatgtttgaagccacagccagaggggctcggcgcatggccatccttggagacaccgcttgggatttcggctccgttgggggagtgctcaacagcctgggcaagatggtccaccagatttttgggtctgcctacacagcgctgttctccggcgtgagctgggtgatgaaaatcggaattggcgtcctcctgacctggatcgggcttaattctaagaacacaagcatgtccttttcttgcattgccatcggaatcattacgctgtatctcggcgctgtggttcaggcctga

SEQ ID NO: 2139 - RNA, 2025 nt, synthetic construct
  misc_feature 1..2025: note = derived and/or modified CDS sequence (opt5) from DENV-3 Consensus__SSc-prMEdelstem_TM-JEV
  source 1..2025: mol_type = other RNA
atgaccagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcgccaggtggaaaaagttgagacatgggccctccggcaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaggggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctacacttggcaaagcctttagcaccaccctcaagggggctcagcggctggccgctctgggagacacagcctgggatttcggctccattgggggagtgtttaacagcatcggcagagcggttcaccaggtcttcgggggcgcctttcgcaccctcttcggaggcatgtcttggattacacaggggctgatgggagcccttctgctctggatgggcgtgaatgctcgggacagatccatcgctctggcctttctggcgaccgggggagtgcttgtcttcctcgccacgaacgtgcatgcttga

SEQ ID NO: 2140 - RNA, 1326 nt, synthetic construct
  misc_feature 1..1326: note = derived and/or modified CDS sequence (opt5) from DENV-3 Consensus__SSm-EdelTM
  source 1..1326: mol_type = other RNA
atgacccagaaggtggtcatcttcattctgctcatgctggttacacccagcatgacgatgagatgcgtgggcgtggggaaccgggactttgtcgagggactttccggcgccacctgggtggatgttgtgctggaacacgggggatgtgtcacaaccatggctaaaaataagcctacactcgacatcgagctgcagaaaaccgaagccacacagcttgcgaccctgcgcaagctctgcattgagggcaaaatcacgaacattaccacagattctagatgtccgacccagggggaagctacactgcccgaggagcaggaccaaaattacgtgtgcaagcatacctatgttgatcggggatggggcaacggctgtgggctgttcggaaagggcagcctcgtgacgtgcgccaaatttcagtgtctggaacctatcgaggggaaggtcgtgcagtacgaaaatcttaaatatacagtgatcattaccgtccacacaggagaccagcatcaagttggcaacgagacccagggggtgaccgccgagatcacaccccaggcttccacgaccgaagccattctgcctgagtacggaacactcggcctggaatgctctccccgcaccggccttgatttcaatgagatgatcctgctcacaatgaagaacaaggcttggatggtgcacagacagtggtttttcgacctgcctctgccgtggaccagcggggccacgacagaaacccccacctggaatcggaaagagctcctggtcacatttaagaacgcgcatgccaaaaagcaagaggtggttgtgcttggatcccaggaaggcgctatgcacaccgccctgacaggggctacggagattcaaaattctggaggcaccagcatcttcgccgggcacctcaaatgtcgcctgaagatggataaacttgaactgaagggaatgtcctatgcgatgtgcacaaacacctttgtcctcaaaaaggaggtgagcgaaacacaacatggcaccattctgatcaaggttgagtacaaaggcgaggacgtgccttgtaagatccccttctctacggaagatgggcagggaaaagcccacaatggcagactgattaccgctaaccctgtcgtgacaaagaaagaggaacccgtcaatatcgaggccgaaccgccttttggggagtccaacattgtgatcggaattggcgacaacgctctcaagatcaattggtataagaaagggagctctatcggcaagatgttcgaggccaccgcccggggagctcgcagaatggcgattctgggcgatacagcctgggactttgggtcctga

SEQ ID NO: 2141 - RNA, 2373 nt, synthetic construct
  misc_feature 1..2373: note = derived and/or modified CDS sequence (opt5) from DENV-3 Consensus__C-P2A-SSc-prME
  source 1..2373: mol_type = other RNA
atgaacaatcagagaaagaaaaccggcaagcccagcatcaacatgctgaaacgggtgcgcaatagagtctccacagggtctcaactcgccaagcggttcagcaaaggactgcttaacggccaggggcctatgaagctggttatggcttttattgccttcctccgctttctggcgatcccgcccacggctggagtgcttgccagatggggcaccttcaagaaatccggggccattaaggtgctgaaaggatttaagaaagagatctctaatatgctcagcattatcaacaagcggaagaaaaatttcgacctgctgaagctcgctggcgatgtcgaatccaaccctggccccacatctctgtgccttatgatgatcctgcctgccgctctcgcctttcacctgaccagccgcgacggggagcccagaatgattgtgggcaaaaatgaacggggaaagtcccttctgttcaaaacagcgagcgggatcaacatgtgtaccctcattgccatggatctgggagagatgtgcgacgatacagttacctacaagtgtcctcatatcacggaagtggagccggaggacattgattgctggtgtaatctgacctctacatgggtcacctatggcacatgcaaccaggctggggaacaccgcagagacaaacggtccgtggccctcgctccccatgttggaatgggcctggatacccgcacgcagacatggatgagcgccgagggcgcgtggagacaagtggaaaaggtcgagacctgggcccttcggcaccctgggtttacaatcctggctctcttcctggcccattacattggaacctctcttacccagaaggtggtgatctttatcctgctcatgctggtcacaccctccatgacgatgcgctgtgttggcgtggggaatagagacttcgtggagggactgagcggcgctacctgggtcgatgtggttctcgaacacgggggatgcgtgacaaccatggccaaaaacaagcctacactggacattgagcttcagaaaaccgaagccacgcagctggctacactccggaagctgtgtatcgagggcaaaattaccaatatcaccacagattctagatgccccacccaaggcgaagcgacacttccggaggagcaggaccagaactatgtctgtaagcacacgtacgtggaccgcgggtggggaaacggctgcgggctgtttggaaagggctccctcgttacctgcgccaaattccagtgtctggaacctattgaggggaaggtggtccaatatgaaaatctgaaatacacagtgatcatcaccgtccatacaggcgatcagcaccaggtgggaaacgagacccaaggcgttacggctgaaattacaccccaggccagcaccaccgaggccatcctccctgagtatgggacactgggacttgaatgctctccccggaccggcctggacttcaatgagatgattctcctgacgatgaagaacaaggcttggatggtgcatagacagtggtttttcgatctgccccttccttggacatccggggccaccacagaaaccccgacctggaatcgcaaagagctcctggtcacatttaagaacgcgcacgctaaaaagcaggaagtggttgtgctgggaagccaagagggcgccatgcacacggccctcaccggggctacagagatccaaaattccggcggaaccagcattttcgccggccatctgaaatgtcggcttaagatggacaaactggaactcaaggggatgtcttacgctatgtgcacaaacacctttgtcctgaagaaagaggtgtccgaaacgcagcacggaacaatcctgatcaaggtggagtacaaaggcgaggatgttccctgtaagattcctttcagcaccgaagacgggcagggaaaagcccataatggcagacttatcaccgcgaaccccgtcgtgacaaagaaagaggaacctgtgaatattgaggccgaacccccgtttggggagtctaacatcgtcattggcatcggagataatgctctcaagattaactggtataagaaaggcagctccatcgggaagatgttcgaggccaccgctcgcggagcccggagaatggcgatcctgggcgacacagcctgggattttgggtctgtgggaggcgttctgaatagcctcgggaaaatggtgcaccagattttcggctccgcttacacggccctgtttagcggagtctcttgggtgatgaagatcggcattggggttcttctgacctggatcggactcaactccaaaaacacaagcatgtctttctcctgcattgctatcggcatcattaccctgtatctgggggccgtggtccaggcctga

SEQ ID NO: 2142 - RNA, 2037 nt, synthetic construct
  misc_feature 1..2037: note = derived and/or modified CDS sequence (opt5) from DENV-3 Consensus__SSopt-prME
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaaatgtagactcaagatggacaaactggagcttaagggcatgtcttacgctatgtgcacgaacacctttgttctgaagaaagaggtgtccgaaacacagcacgggaccatcctcatcaaggtcgagtacaaaggagaagatgtgccctgtaagattcctttcagcacagaggacggccaggggaaagcccataacggacggctgatcaccgcgaatcccgttgtgacgaagaaggaggaacccgtcaacattgaggctgaacctccgttcggcgagtccaatatcgtgattgggatcggcgataacgccctgaaaatcaattggtataagaaaggatctagcattggcaagatgtttgaagccacagctagaggggcccgccggatggctatccttggagacaccgcctgggatttcggctccgttgggggagtgctcaacagcctgggcaaaatggtccaccagatttttgggtctgcgtacaccgccctgttctccggcgtgagctgggtgatgaagatcggaattggcgtcctcctgacatggatcgggcttaattctaagaacaccagcatgtccttttcttgcattgctatcggaatcattacactgtatctcggcgccgtggttcaggcttga

SEQ ID NO: 2143 - RNA, 2037 nt, synthetic construct
  misc_feature 1..2037: note = derived and/or modified CDS sequence (opt5) from DENV-3 Consensus__SSopt-prME(F108S)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgagcgggaagggatctcttgtcacatgcgccaaattccaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctccacaaccgaggctatcctgcccgaatatggcacgctggggctcgagtgcagccctagaaccggactggactttaatgagatgattcttctgacaatgaagaacaaagcctggatggtgcatcggcagtggttctttgatctccccctgccgtggacctctggcgccacaaccgaaacgcctacatggaatcgcaaggagcttctggtcaccttcaagaacgctcacgcgaaaaagcaagaagtggtcgtgctcgggtcccaggagggagccatgcacacagctctgaccggcgccaccgaaatccagaatagcgggggcacatctatttttgccggacatctgaaatgtagactcaagatggacaaactggagcttaagggcatgtcctacgctatgtgcacgaacaccttcgttctgaagaaagaggtgagcgaaacacagcacgggaccatcctcatcaaggtcgagtacaaaggagaagatgtgccctgtaagattcctttttccacagaggacggccaagggaaagcccataacggacggctgatcaccgcgaatcccgttgtgacgaagaaggaggaacccgtcaacattgaggctgaacctccgttcggcgagtctaatatcgtgattgggatcggcgataacgccctgaaaatcaattggtataagaaaggaagctccattggcaagatgttcgaagccacagctagaggggcccgccggatggctatccttggagacaccgcctgggattttggcagcgttgggggagtgctcaactctctgggcaaaatggtccaccagattttcgggtccgcgtacaccgccctgtttagcggcgtgtcttgggtgatgaagatcggaattggcgtcctcctgacatggatcgggcttaatagcaagaacacctccatgtctttcagctgcattgctatcggaatcattacactgtatctcggcgccgtggttcaggcttga

SEQ ID NO: 2144 - RNA, 2037 nt, synthetic construct
  misc_feature 1..2037: note = derived and/or modified CDS sequence (opt5) from DENV-3 Consensus__SSopt-prME(H27N)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagaatggcgggtgcgttaccacaatggccaaaaacaagcccacgctggacattgagctccagaaaaccgaagctacacaactggccacccttagaaagctgtgtatcgagggaaagattacaaatatcaccacggattcccggtgccctacacagggcgaagcgaccctcccggaggaacaggaccagaactatgtgtgtaaacacacctacgtggatcgcggctgggggaatggatgcggcctgttcgggaagggaagccttgtcacatgcgccaaatttcaatgtctggagcccattgagggcaaggtggttcagtatgaaaacctcaaatacaccgtgatcatcacagtccacacgggggaccagcatcaggtgggaaatgagacccaaggcgttacagctgaaattacccctcaggcctctacaaccgaggctatcctgcccgaatatggcacgctggggctcgagtgctcccctagaaccggactggacttcaacgagatgattcttctgacaatgaagaataaagcctggatggtgcaccggcagtggtttttcgatctccccctgccgtggaccagcggcgccacaaccgaaacgcctacatggaaccgcaaggagcttctggtcacctttaagaatgctcatgcgaaaaagcaagaagtggtcgtgctcgggtctcaggagggagccatgcacacagctctgaccggcgccaccgaaatccagaactccgggggcacaagcattttcgccggacacctgaaatgtagactcaagatggacaaactggagcttaagggcatgtcttacgctatgtgcacgaacacctttgttctgaagaaagaggtgtccgaaacacagcatgggaccatcctcatcaaggtcgagtacaaaggagaagatgtgccctgtaagattcctttcagcacagaggacggccaagggaaagcccacaatggacggctgatcaccgcgaaccccgttgtgacgaagaaggaggaacccgtcaatattgaggctgaacctccgttcggcgagtccaacatcgtgattgggatcggcgataatgccctgaaaatcaactggtataagaaaggatctagcattggcaagatgtttgaagccacagctagaggggcccgccggatggctatccttggagacaccgcctgggatttcggctccgttgggggagtgctcaatagcctgggcaaaatggtccatcagatttttgggtctgcgtacaccgccctgttctccggcgtgagctgggtgatgaagatcggaattggcgtcctcctgacatggatcgggcttaactctaagaataccagcatgtccttttcttgcattgctatcggaatcattacactgtatctcggcgccgtggttcaggcttga

SEQ ID NO: 2145 - RNA, 2037 nt, synthetic construct
  misc_feature 1..2037: note = derived and/or modified CDS sequence (opt5) from DENV-3 Consensus__SSopt-prME(T76I)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctattcagggcgaagcgacactcccggaggaacaggaccagaattatgtgtgtaaacacacctacgtggatcgcggctgggggaacggatgcggcctgttcgggaagggaagccttgtgacctgcgccaaatttcaatgtctggagcccatcgagggcaaggtggttcagtatgaaaatctcaaatacacagtgatcattaccgtccatacaggggaccagcaccaggtgggaaacgagacgcaaggcgttaccgctgaaatcacacctcaggcctctaccacagaggctattctgcccgaatatggcaccctggggctcgagtgctcccctagaacgggactggacttcaatgagatgatccttctgaccatgaagaacaaagcctggatggtgcatcggcagtggtttttcgatctccccctgccgtggacaagcggcgccaccacagaaacccctacgtggaatcgcaaggagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaaatgtagactcaagatggacaaactggagcttaagggcatgtcttacgctatgtgcacaaacacgtttgttctgaagaaagaggtgtccgaaacccagcacgggacaatcctcattaaggtcgagtacaaaggagaagatgtgccctgtaagatccctttcagcaccgaggacggccaggggaaagcccataacggacggctgattacagcgaatcccgttgtgaccaagaaggaggaacccgtcaacatcgaggctgaacctccgttcggcgagtccaatattgtgatcgggatcggcgataacgccctgaaaattaattggtataagaaaggatctagcatcggcaagatgtttgaagccacggctagaggggcccgccggatggctattcttggagacacagcctgggatttcggctccgtcgggggagttctcaacagcctgggcaaaatggtccaccagatctttgggtctgcgtacaccgccctgttctccggcgtgagctgggtgatgaagattggaatcggcgtcctcctgacctggattgggcttaattctaagaacacaagcatgtccttttcttgcatcgctatcggaattatcaccctgtatctcggcgccgtggttcaggcttga

SEQ ID NO: 2146 - RNA, 2037 nt, synthetic construct
  misc_feature 1..2037: note = derived and/or modified CDS sequence (opt5) from DENV-3 Consensus__SSopt-prME(N89D)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccaggattatgtgtgtaaacacacctacgtggaccgcggctgggggaatggatgcggcctgttcgggaagggaagccttgtcacatgcgccaaatttcaatgtctggagcccattgagggcaaggtggttcagtatgaaaacctcaaatacaccgtgatcatcacagtccatacgggggaccagcaccaggtgggaaatgagacccaaggcgttacagctgaaattacccctcaggcctctacaaccgaggctatcctgcccgaatatggcacgctggggctcgagtgctcccctagaaccggactggatttcaacgagatgattcttctgacaatgaagaataaagcctggatggtgcatcggcagtggtttttcgacctccccctgccgtggaccagcggcgccacaaccgaaacgcctacatggaaccgcaaggagcttctggtcacctttaagaatgctcacgcgaaaaagcaagaagtggtcgtgctcgggtctcaggagggagccatgcacacagctctgaccggcgccaccgaaatccagaactccgggggcacaagcattttcgccggacatctgaaatgtagactcaagatggataaactggagcttaagggcatgtcttacgctatgtgcacgaatacctttgttctgaagaaagaggtgtccgaaacacagcacgggaccatcctcatcaaggtcgagtacaaaggagaagacgtgccctgtaagattcctttcagcacagaggatggccaagggaaagcccataacggacggctgatcaccgcgaaccccgttgtgacgaagaaggaggaacccgtcaatattgaggctgaacctccgttcggcgagtccaacatcgtgattgggatcggcgacaatgccctgaaaatcaactggtataagaaaggatctagcattggcaagatgtttgaagccacagctagaggggcccgccggatggctatccttggagataccgcctgggacttcggctccgttgggggagtgctcaatagcctgggcaaaatggtccaccagatttttgggtctgcgtacaccgccctgttctccggcgtgagctgggtgatgaagatcggaattggcgtcctcctgacatggatcgggcttaactctaagaataccagcatgtccttttcttgcattgctatcggaatcattacactgtatctcggcgccgtggttcaggcttga

SEQ ID NO: 2147 - RNA, 2037 nt, synthetic construct
  misc_feature 1..2037: note = derived and/or modified CDS sequence (opt5) from DENV-3 Consensus__SSopt-prME(Y96H)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacccatgtggatcgcggctgggggaacggatgcggcctgttcgggaagggaagccttgtcacatgcgccaaatttcaatgtctggagcccattgagggcaaggtggttcagtacgaaaatctcaaatataccgtgatcatcacagtccacacgggggaccagcatcaggtgggaaacgagacccaaggcgttacagctgaaattacccctcaggcctctacaaccgaggctatcctgcccgaatacggcacgctggggctcgagtgctcccctagaaccggactggacttcaatgagatgattcttctgacaatgaagaacaaagcctggatggtgcaccggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgcatacagctctgaccggcgccaccgaaatccaaaattccgggggcacaagcattttcgccggacacctgaaatgtagactcaagatggacaaactggagcttaagggcatgtcttatgctatgtgcacgaacacctttgttctgaagaaagaggtgtccgaaacacagcatgggaccatcctcatcaaggtcgagtacaaaggagaagatgtgccctgtaagattcctttcagcacagaggacggccaggggaaagcccacaacggacggctgatcaccgcgaatcccgttgtgacgaagaaggaggaacccgtcaacattgaggctgaacctccgttcggcgagtccaatatcgtgattgggatcggcgataacgccctgaaaatcaattggtacaagaaaggatctagcattggcaagatgtttgaagccacagctagaggggcccgccggatggctatccttggagacaccgcctgggatttcggctccgttgggggagtgctcaacagcctgggcaaaatggtccatcagatttttgggtctgcgtataccgccctgttctccggcgtgagctgggtgatgaagatcggaattggcgtcctcctgacatggatcgggcttaattctaagaacaccagcatgtccttttcttgcattgctatcggaatcattacactgtacctcggcgccgtggttcaggcttga

SEQ ID NO: 2148 - RNA, 2037 nt, synthetic construct
  misc_feature 1..2037: note = derived and/or modified CDS sequence (opt5) from DENV-3 Consensus__SSopt-prME(K110E)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcggggagggaagccttgtcacatgcgccaagtttcaatgtctggagcccattgaaggcaaagtggttcagtatgagaatctcaagtacaccgtgatcatcacagtccatacgggggaccagcaccaggtgggaaacgaaacccaaggcgttacagctgagattacccctcaggcctctacaaccgaagctatcctgcccgagtatggcacgctggggctcgagtgctcccctagaaccggactggacttcaatgaaatgattcttctgacaatgaaaaacaaggcctggatggtgcatcggcagtggtttttcgatctccccctgccgtggaccagcggcgccacaaccgagacgcctacatggaatcgcaaagaacttctggtcacctttaagaacgctcacgcgaagaaacaagaggtggtcgtgctcgggtctcaggaaggagccatgcacacagctctgaccggcgccaccgagatccaaaattccgggggcacaagcattttcgccggacatctgaagtgtagactcaaaatggacaagctggagcttaaaggcatgtcttacgctatgtgcacgaacacctttgttctgaagaaggaagtgtccgagacacagcacgggaccatcctcatcaaagtcgaatacaagggagaggatgtgccctgtaaaattcctttcagcacagaggacggccaggggaaggcccataacggacggctgatcaccgcgaatcccgttgtgacgaaaaaggaggaacccgtcaacattgaagctgagcctccgttcggcgaatccaatatcgtgattgggatcggcgataacgccctgaagatcaattggtataaaaagggatctagcattggcaaaatgtttgaggccacagctagaggggcccgccggatggctatccttggagacaccgcctgggatttcggctccgttgggggagtgctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggcttga

SEQ ID NO: 2149 - RNA, 2037 nt, synthetic construct
  misc_feature 1..2037: note = derived and/or modified CDS sequence (opt5) from DENV-3 Consensus__SSopt-prME(H149N)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagaaccaggtgggaaatgagacccaaggcgttacagctgaaattacccctcaggcctctacaaccgaggctatcctgcccgaatatggcacgctggggctcgagtgctcccctagaaccggactggacttcaacgagatgattcttctgacaatgaagaataaagcctggatggtgcaccggcagtggtttttcgatctccccctgccgtggaccagcggcgccacaaccgaaacgcctacatggaaccgcaaggagcttctggtcacctttaagaatgctcatgcgaaaaagcaagaagtggtcgtgctcgggtctcaggagggagccatgcacacagctctgaccggcgccaccgaaatccagaactccgggggcacaagcattttcgccggacacctgaaatgtagactcaagatggacaaactggagcttaagggcatgtcttacgctatgtgcacgaacacctttgttctgaagaaagaggtgtccgaaacacagcatgggaccatcctcatcaaggtcgagtacaaaggagaagatgtgccctgtaagattcctttcagcacagaggacggccaagggaaagcccacaatggacggctgatcaccgcgaaccccgttgtgacgaagaaggaggaacccgtcaatattgaggctgaacctccgttcggcgagtccaacatcgtgattgggatcggcgataatgccctgaaaatcaactggtataagaaaggatctagcattggcaagatgtttgaagccacagctagaggggcccgccggatggctatccttggagacaccgcctgggatttcggctccgttgggggagtgctcaatagcctgggcaaaatggtccatcagatttttgggtctgcgtacaccgccctgttctccggcgtgagctgggtgatgaagatcggaattggcgtcctcctgacatggatcgggcttaactctaagaataccagcatgtccttttcttgcattgctatcggaatcattacactgtatctcggcgccgtggttcaggcttga

SEQ ID NO: 2150 - RNA, 2037 nt, synthetic construct
  misc_feature 1..2037: note = derived and/or modified CDS sequence (opt5) from DENV-3 Consensus__SSopt-prME(S184F)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgcttccctagaaccggactggactttaatgagatgattcttctgacaatgaagaacaaagcctggatggtgcatcggcagtggttctttgatctccccctgccgtggacctccggcgccacaaccgaaacgcctacatggaatcgcaaggagcttctggtcaccttcaagaacgctcacgcgaaaaagcaagaagtggtcgtgctcgggagccaggagggagccatgcacacagctctgaccggcgccaccgaaatccaaaattctgggggcacatccatttttgccggacatctgaaatgtagactcaagatggacaaactggagcttaagggcatgagctacgctatgtgcacgaacaccttcgttctgaagaaagaggtgtctgaaacacagcacgggaccatcctcatcaaggtcgagtacaaaggagaagatgtgccctgtaagattcctttctccacagaggacggccaggggaaagcccataacggacggctgatcaccgcgaatcccgttgtgacgaagaaggaggaacccgtcaacattgaggctgaacctccgtttggcgagagcaatatcgtgattgggatcggcgataacgccctgaaaatcaattggtataagaaaggatcctctattggcaagatgttcgaagccacagctagaggggcccgccggatggctatccttggagacaccgcctgggattttggcagcgttgggggagtgctcaactccctgggcaaaatggtccaccagattttcgggagcgcgtacaccgccctgttttctggcgtgtcctgggtgatgaagatcggaattggcgtcctcctgacatggatcgggcttaatagcaagaacacctctatgagcttctcctgcattgctatcggaatcattacactgtatctcggcgccgtggttcaggcttga

SEQ ID NO: 2151 - RNA, 2037 nt, synthetic construct
  misc_feature 1..2037: note = derived and/or modified CDS sequence (opt5) from DENV-3 Consensus__SSopt-prME(R186L)
  source 1..2037: mol_type = other RNA
atgaagcggaaaaagaccagcctgtgcctcatgatgatcctgcccgccgctcttgccttccacctgacatcccgggacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctctgaccggacttgacttcaatgagatgattctgctcacaatgaagaacaaagcctggatggtgcatagacagtggtttttcgatctgccccttccgtggaccagcggcgccacaaccgaaacgcctacatggaatcggaaggagctgctcgtcacctttaagaacgctcacgcgaaaaagcaagaagtggtcgtgctggggtctcaggagggagccatgcacacagctctgaccggcgccaccgaaatccaaaattccgggggcacaagcattttcgccggacatctcaaatgtcgcctgaagatggacaaacttgagctgaagggcatgtcttacgctatgtgcacgaacacctttgttctcaagaaagaggtgtccgaaacacagcacgggaccatcctgatcaaggtcgagtacaaaggagaagatgtgccctgtaagattcctttcagcacagaggacggccaggggaaagcccataacggaagactgatcaccgcgaatcccgttgtgacgaagaaggaggaacccgtcaacattgaggctgaacctccgttcggcgagtccaatatcgtgattgggatcggcgataacgcccttaaaatcaattggtataagaaaggatctagcattggcaagatgtttgaagccacagctagaggggccagacgcatggctatcctcggagacaccgcctgggatttcggctccgttgggggagtgctgaacagcctgggcaaaatggtccaccagatttttgggtctgcgtacaccgccctcttctccggcgtgagctgggtgatgaagatcggaattggcgtcctgcttacatggatcgggctcaattctaagaacaccagcatgtccttttcttgcattgctatcggaatcattacactgtatctgggcgccgtggttcaggcttga

SEQ ID NO: 2152 - RNA, 2037 nt, synthetic construct
  misc_feature 1..2037: note = derived and/or modified CDS sequence (opt5) from DENV-3 Consensus__SSopt-prME(N240S)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagtctgctcacgcgaaaaagcaagaagtggtcgtgctcgggtcccaggagggagccatgcacacagctctgaccggcgccaccgaaatccagaacagcgggggcacatctattttcgccggacatctgaaatgtagactcaagatggacaaactggagcttaagggcatgtcctacgctatgtgcacgaatacctttgttctgaagaaagaggtgagcgaaacacagcacgggaccatcctcatcaaggtcgagtacaaaggagaagatgtgccctgtaagattcctttctccacagaggacggccaagggaaagcccataacggacggctgatcaccgcgaaccccgttgtgacgaagaaggaggaacccgtcaatattgaggctgaacctccgttcggcgagtctaacatcgtgattgggatcggcgataatgccctgaaaatcaactggtataagaaaggaagctccattggcaagatgtttgaagccacagctagaggggcccgccggatggctatccttggagacaccgcctgggatttcggcagcgttgggggagtgctcaattctctgggcaaaatggtccaccagatttttgggtccgcgtacaccgccctgttcagcggcgtgtcttgggtgatgaagatcggaattggcgtcctcctgacatggatcgggcttaacagcaagaatacctccatgtcttttagctgcattgctatcggaatcattacactgtatctcggcgccgtggttcaggcttga

SEQ ID NO: 2153 - RNA, 2037 nt, synthetic construct
  misc_feature 1..2037: note = derived and/or modified CDS sequence (opt5) from DENV-3 Consensus__SSopt-prME(M258L)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccctgcacacagctctgaccggcgccaccgaaatccaaaattccgggggcacaagcattttcgccggacatctcaaatgtagactgaagatggacaaacttgagctgaagggcatgtcttacgctatgtgcacgaacacctttgttctcaagaaagaggtgtccgaaacacagcacgggaccatcctgatcaaggtcgagtacaaaggagaagatgtgccctgtaagattcctttcagcacagaggacggccaggggaaagcccataacggacggctgatcaccgcgaatcccgttgtgacgaagaaggaggaacccgtcaacattgaggctgaacctccgttcggcgagtccaatatcgtgattgggatcggcgataacgcccttaaaatcaattggtataagaaaggatctagcattggcaagatgtttgaagccacagctagaggggcccgccggatggctatcctcggagacaccgcctgggatttcggctccgttgggggagtgctgaacagcctgggcaaaatggtccaccagatttttgggtctgcgtacaccgccctcttctccggcgtgagctgggtgatgaagatcggaattggcgtcctgcttacatggatcgggctcaattctaagaacaccagcatgtccttttcttgcattgctatcggaatcattacactgtatctgggcgccgtggttcaggcttga

SEQ ID NO: 2154 - RNA, 2037 nt, synthetic construct
  misc_feature 1..2037: note = derived and/or modified CDS sequence (opt5) from DENV-3 Consensus__SSopt-prME(H259N)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgaatacagctctgaccggcgccaccgaaatccagaactccgggggcacaagcattttcgccggacacctgaaatgtagactcaagatggacaaactggagcttaagggcatgtcttacgctatgtgcacgaacacctttgttctgaagaaagaggtgtccgaaacacagcatgggaccatcctcatcaaggtcgagtacaaaggagaagatgtgccctgtaagattcctttcagcacagaggacggccaagggaaagcccacaatggacggctgatcaccgcgaaccccgttgtgacgaagaaggaggaacccgtcaatattgaggctgaacctccgttcggcgagtccaacatcgtgattgggatcggcgataatgccctgaaaatcaactggtataagaaaggatctagcattggcaagatgtttgaagccacagctagaggggcccgccggatggctatccttggagacaccgcctgggatttcggctccgttgggggagtgctcaatagcctgggcaaaatggtccatcagatttttgggtctgcgtacaccgccctgttctccggcgtgagctgggtgatgaagatcggaattggcgtcctcctgacatggatcgggcttaactctaagaataccagcatgtccttttcttgcattgctatcggaatcattacactgtatctcggcgccgtggttcaggcttga

SEQ ID NO: 2155 - RNA, 2037 nt, synthetic construct
  misc_feature 1..2037: note = derived and/or modified CDS sequence (opt5) from DENV-3 Consensus__SSopt-prME(H259R)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgagaacagctctgaccggcgccaccgaaatccaaaattccgggggcacaagcattttcgccggacacctgaaatgtcggctcaagatggacaaactggagcttaagggcatgtcttacgctatgtgcacgaacacctttgttctgaagaaagaggtgtccgaaacacagcatgggaccatcctcatcaaggtcgagtacaaaggagaagatgtgccctgtaagattcctttcagcacagaggacggccaggggaaagcccacaacggaagactgatcaccgcgaatcccgttgtgacgaagaaggaggaacccgtcaacattgaggctgaacctccgttcggcgagtccaatatcgtgattgggatcggcgataacgccctgaaaatcaattggtataagaaaggatctagcattggcaagatgtttgaagccacagctcgcggggcccggagaatggctatccttggagacaccgcctgggatttcggctccgttgggggagtgctcaacagcctgggcaaaatggtccatcagatttttgggtctgcgtacaccgccctgttctccggcgtgagctgggtgatgaagatcggaattggcgtcctcctgacatggatcgggcttaattctaagaacaccagcatgtccttttcttgcattgctatcggaatcattacactgtatctcggcgccgtggttcaggcttga

SEQ ID NO: 2156 - RNA, 2037 nt, synthetic construct
  misc_feature 1..2037: note = derived and/or modified CDS sequence (opt5) from DENV-3 Consensus__SSopt-prME(A265T)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgcacacagctctgaccggcaccacagaaatccaaaattccgggggcacgagcattttcgccggacatctgaaatgtagactcaagatggacaaactggagcttaagggcatgtcttacgccatgtgcaccaacacatttgttctgaagaaagaggtgtccgaaacccagcacgggacaatcctcatcaaggtcgagtacaaaggagaagatgtgccctgtaagattcctttcagcaccgaggacggccaggggaaagctcataacggacggctgatcacggccaatcccgttgtgacaaagaaggaggaacccgtcaacattgaggcggaacctccgttcggcgagtccaatatcgtgattgggatcggcgataacgctctgaaaatcaattggtataagaaaggatctagcattggcaagatgtttgaagccaccgccagaggggctcgccggatggccatccttggagacaccgcttgggatttcggctccgttgggggagtgctcaacagcctgggcaaaatggtccaccagatttttgggtctgcctacacagcgctgttctccggcgtgagctgggtgatgaagatcggaattggcgtcctcctgacctggatcgggcttaattctaagaacacaagcatgtccttttcttgcattgccatcggaatcattacgctgtatctcggcgctgtggttcaggcctga

SEQ ID NO: 2157 - RNA, 2037 nt, synthetic construct
  misc_feature 1..2037: note = derived and/or modified CDS sequence (opt5) from DENV-3 Consensus__SSopt-prME(S296G)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaaatgtagactcaagatggacaaactggagcttaagggcatggggtacgctatgtgcacgaacacctttgttctgaagaaagaggtgtctgaaacacagcacggaaccatcctcatcaaggtcgagtacaaaggcgaagatgtgccctgtaagattcctttctccacagaggacgggcagggaaaagcccataacggccggctgatcaccgcgaatcccgttgtgacgaagaaggaggaacccgtcaacattgaggctgaacctccgttcggggagagcaatatcgtgattggcatcggagataacgccctgaaaatcaattggtataagaaaggctcctctattgggaagatgtttgaagccacagctagaggagcccgccggatggctatccttggcgacaccgcctgggatttcgggagcgtgggaggcgttctcaactccctggggaaaatggtccaccagatttttggcagcgcgtacaccgccctgttctctggagtgtcctgggtgatgaagatcggcattggggtcctcctgacatggatcggacttaatagcaagaacacctctatgagcttttcctgcattgctatcggcatcattacactgtatctcggggccgtggttcaggcttga

SEQ ID NO: 2158 - RNA, 2037 nt, synthetic construct
  misc_feature 1..2037: note = derived and/or modified CDS sequence (opt5) from DENV-3 Consensus__SSopt-prME(S311R)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaaatgtagactcaagatggacaaactggagcttaagggcatgtcttacgctatgtgcacgaacacctttgttctgaagaaagaggtgcgggaaacacagcacgggaccatcctcatcaaggtcgagtacaaaggagaagatgtgccctgtaagattcctttctccacagaggacggccaggggaaagcccataacggaagactgatcaccgcgaatcccgttgtgacgaagaaggaggaacccgtcaacattgaggctgaacctccgttcggcgagagcaatatcgtgattgggatcggcgataacgccctgaaaatcaattggtataagaaaggatcctctattggcaagatgtttgaagccacagctcgcggggcccggagaatggctatccttggagacaccgcctgggatttcggcagcgttgggggagtgctcaactccctgggcaaaatggtccaccagatttttgggagcgcgtacaccgccctgttctctggcgtgtcctgggtgatgaagatcggaattggcgtcctcctgacatggatcgggcttaatagcaagaacacctctatgagcttttcctgcattgctatcggaatcattacactgtatctcggcgccgtggttcaggcttga

SEQ ID NO: 2159 - RNA, 2037 nt, synthetic construct
  misc_feature 1..2037: note = derived and/or modified CDS sequence (opt5) from DENV-3 Consensus__SSopt-prME(K321T)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaaatgtagactcaagatggacaaactggagcttaagggcatgtcttacgctatgtgcacgaacacctttgttctgaagaaagaggtgtccgaaacacagcacgggaccatcctcatcacagtcgagtacaagggagaagatgtgccctgtaaaattcctttcagcaccgaggacggccaggggaaggcccataacggacggctgatcacggcgaatcccgttgtgaccaaaaaggaggaacccgtcaacattgaggctgaacctccgttcggcgagtccaatatcgtgattgggatcggcgataacgccctgaagatcaattggtataaaaagggatctagcattggcaaaatgtttgaagccacagctagaggggcccgccggatggctatccttggagacaccgcctgggatttcggctccgttgggggagtgctcaacagcctgggcaagatggtccaccagatttttgggtctgcgtacacagccctgttctccggcgtgagctgggtgatgaaaatcggaattggcgtcctcctgacctggatcgggcttaattctaagaacacaagcatgtccttttcttgcattgctatcggaatcattacgctgtatctcggcgccgtggttcaggcttga

SEQ ID NO: 2160 - RNA, 2037 nt, synthetic construct
  misc_feature 1..2037: note = derived and/or modified CDS sequence (opt5) from DENV-3 Consensus__SSopt-prME(G28C,H242C)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcactgcggctgtgttaccacaatggccaaaaataagcccacgctggacattgagctccagaaaaccgaagctacacaactggccacccttagaaagctgtgcatcgaggggaagattacaaacatcaccacggattcccggtgtcctacacagggagaagcgaccctcccggaggaacaggaccagaattatgtgtgcaaacacacctacgtggatcgcggctggggcaacgggtgcggactgttcggcaaggggagccttgtcacatgtgccaaatttcaatgcctggagcccattgagggaaaggtggttcagtatgaaaatctcaaatacaccgtgatcatcacagtccatacgggcgaccagcaccaggtggggaacgagacccaaggagttacagctgaaattacccctcaggcctctacaaccgaggctatcctgcccgaatatggcacgctgggcctcgagtgttcccctagaaccgggctggacttcaatgagatgattcttctgacaatgaagaacaaagcctggatggtgcatcggcagtggtttttcgatctccccctgccgtggaccagcggagccacaaccgaaacgcctacatggaatcgcaaggagcttctggtcacctttaagaacgcttgcgcgaaaaagcaagaagtggtcgtgctcggctctcaggagggggccatgcacacagctctgaccggagccaccgaaatccaaaattccggcgggacaagcattttcgccggccacctgaaatgtagactcaagatggacaaactggagcttaagggaatgtcttacgctatgtgcacgaacacctttgttctgaagaaagaggtgtccgaaacacagcatggcaccatcctcatcaaggtcgagtacaaaggggaagatgtgccctgtaagattcctttcagcacagaggacggacagggcaaagcccacaacgggcggctgatcaccgcgaatcccgttgtgacgaagaaggaggaacccgtcaacattgaggctgaacctccgttcggagagtccaatatcgtgattggcatcggggataacgccctgaaaatcaattggtataagaaaggctctagcattggaaagatgtttgaagccacagctagaggcgcccgccggatggctatccttggggacaccgcctgggatttcggatccgtgggcggggttctcaacagcctgggaaaaatggtccatcagatttttggctctgcgtacaccgccctgttctccggggtgagctgggtgatgaagatcggcattggagtcctcctgacatggatcggccttaattctaagaacaccagcatgtccttttcttgcattgctatcgggatcattacactgtatctcggagccgtggttcaggcttga

SEQ ID NO: 2161 - RNA, 2037 nt, synthetic construct
  misc_feature 1..2037: note = derived and/or modified CDS sequence (opt5) from DENV-3 Consensus__SSopt-prME(R186L,A265T)
  source 1..2037: mol_type = other RNA
atgaagcggaaaaagaccagcctgtgcctcatgatgatcctgcccgccgctcttgccttccacctgacatcccgggacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctctgaccggacttgacttcaatgagatgattctgctcacaatgaagaacaaagcctggatggtgcatagacagtggtttttcgatctgccccttccgtggaccagcggcgccacaaccgaaacgcctacatggaatcggaaggagctgctcgtcacctttaagaacgctcacgcgaaaaagcaagaagtggtcgtgctggggtctcaggagggagccatgcacacagctctgaccggcaccacagaaatccaaaattccgggggcacgagcattttcgccggacatctcaaatgtcgcctgaagatggacaaacttgagctgaagggcatgtcttacgccatgtgcaccaacacatttgttctcaagaaagaggtgtccgaaacccagcacgggacaatcctgatcaaggtcgagtacaaaggagaagatgtgccctgtaagattcctttcagcaccgaggacggccaggggaaagctcataacggaagactgatcacggccaatcccgttgtgacaaagaaggaggaacccgtcaacattgaggcggaacctccgttcggcgagtccaatatcgtgattgggatcggcgataacgctcttaaaatcaattggtataagaaaggatctagcattggcaagatgtttgaagccaccgccagaggggctagacgcatggccatcctcggagacaccgcttgggatttcggctccgttgggggagtgctgaacagcctgggcaaaatggtccaccagatttttgggtctgcctacacagcgctgttctccggcgtgagctgggtgatgaagatcggaattggcgtcctgcttacctggatcgggctcaattctaagaacacaagcatgtccttttcttgcattgccatcggaatcattacgctctatctgggcgctgtggttcaggcctga

SEQ ID NO: 2162 - RNA, 2037 nt, synthetic construct
  misc_feature 1..2037: note = derived and/or modified CDS sequence (opt5) from DENV-3 Consensus__SSopt-pr(D104A)ME(F108S)
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgccaagagatctgtggctctggcccctcatgtcgggatgggactggacacccggacacaaacctggatgagcgctgagggcgcctggcgccaggtggaaaaagttgagacatgggcgctcagacaccccggcttcaccatcctggccctttttctggctcattacatcgggacgtccctcacacagaaggtggtcattttcatcctgcttatgctggtgaccccttctatgacaatgcggtgtgttggagtgggcaaccgcgattttgtcgaagggctcagcggagccacctgggtggacgtggtcctggagcacggcgggtgcgttaccacaatggctaaaaataagcccacgctggatattgagctccagaaaaccgaagccacacaactggcgacccttagaaagctgtgtatcgagggaaagattacaaacatcaccacggactcccggtgccctacacagggcgaagccaccctcccggaggaacaggatcagaattatgtgtgtaaacacacctacgtggaccgcggctgggggaacggatgcggcctgagcgggaagggatctcttgtcacatgcgctaaattccaatgtctggagcccattgagggcaaggtggttcagtatgaaaatctcaaatacaccgtgatcatcacagtccatacgggggatcagcaccaggtgggaaacgagacccaaggcgttacagccgaaattacccctcaggcttccacaaccgaggccatcctgcccgaatatggcacgctggggctcgagtgcagccctagaaccggactggactttaatgagatgattcttctgacaatgaagaacaaagcctggatggtgcatcggcagtggttctttgacctccccctgccgtggacctctggcgctacaaccgaaacgcctacatggaatcgcaaggagcttctggtcaccttcaagaacgcgcacgccaaaaagcaagaagtggtcgtgctcgggtcccaggagggagctatgcacacagccctgaccggcgccaccgaaatccagaatagcgggggcacatctatttttgctggacatctgaaatgtagactcaagatggataaactggagcttaagggcatgtcctacgccatgtgcacgaacaccttcgttctgaagaaagaggtgagcgaaacacagcacgggaccatcctcatcaaggtcgagtacaaaggagaagacgtgccctgtaagattcctttttccacagaggatggccaagggaaagcgcataacggacggctgatcaccgctaatcccgttgtgacgaagaaggaggaacccgtcaacattgaggccgaacctccgttcggcgagtctaatatcgtgattgggatcggcgacaacgccctgaaaatcaattggtataagaaaggaagctccattggcaagatgttcgaagctacagccagaggggctcgccggatggccatccttggagataccgcgtgggactttggcagcgttgggggagtgctcaactctctgggcaaaatggtccaccagattttcgggtccgcctacaccgctctgtttagcggcgtgtcttgggtgatgaagatcggaattggcgtcctcctgacatggatcgggcttaatagcaagaacacctccatgtctttcagctgcattgccatcggaatcattacactgtatctcggcgctgtggttcaggcctga

SEQ ID NO: 2163 - RNA, 2037 nt, synthetic construct
  misc_feature 1..2037: note = derived and/or modified CDS sequence (opt5) from DENV-3 Consensus__SSopt-pr(D104A)ME(R186L,A265T)
  source 1..2037: mol_type = other RNA
atgaagcggaaaaagaccagcctgtgcctcatgatgatcctgcccgccgctcttgccttccacctgacatcccgggacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgccaagagatctgtggctctggcccctcatgtcgggatgggactggacacccggacacaaacctggatgagcgctgagggcgcctggcgccaggtggaaaaagttgagacatgggcgctcagacaccccggcttcaccatcctggccctttttctggctcattacatcgggacgtccctcacacagaaggtggtcattttcatcctgcttatgctggtgaccccttctatgacaatgcggtgtgttggagtgggcaaccgcgattttgtcgaagggctcagcggagccacctgggtggacgtggtcctggagcacggcgggtgcgttaccacaatggctaaaaataagcccacgctggatattgagctccagaaaaccgaagccacacaactggcgacccttagaaagctgtgtatcgagggaaagattacaaacatcaccacggactcccggtgccctacacagggcgaagccaccctcccggaggaacaggatcagaattatgtgtgtaaacacacctacgtggaccgcggctgggggaacggatgcggcctgttcgggaagggaagccttgtcacatgcgctaaatttcaatgtctggagcccattgagggcaaggtggttcagtatgaaaatctcaaatacaccgtgatcatcacagtccatacgggggatcagcaccaggtgggaaacgagacccaaggcgttacagccgaaattacccctcaggcttctacaaccgaggccatcctgcccgaatatggcacgctggggctcgagtgctcccctctgaccggacttgacttcaatgagatgattctgctcacaatgaagaacaaagcctggatggtgcatagacagtggtttttcgacctgccccttccgtggaccagcggcgctacaaccgaaacgcctacatggaatcggaaggagctgctcgtcacctttaagaacgcgcacgccaaaaagcaagaagtggtcgtgctggggtctcaggagggagctatgcacacagccctgaccggcaccacagaaatccaaaattccgggggcacgagcattttcgccggacatctcaaatgtcgcctgaagatggataaacttgagctgaagggcatgtcttacgctatgtgcaccaacacatttgttctcaagaaagaggtgtccgaaacccagcacgggacaatcctgatcaaggtcgagtacaaaggagaagacgtgccctgtaagattcctttcagcaccgaggatggccaggggaaagcccataacggaagactgatcacggcgaatcccgttgtgacaaagaaggaggaacccgtcaacattgaggctgaacctccgttcggcgagtccaatatcgtgattgggatcggcgacaacgcccttaaaatcaattggtataagaaaggatctagcattggcaagatgtttgaagccaccgctagaggggccagacgcatggctatcctcggagataccgcctgggacttcggctccgttgggggagtgctgaacagcctgggcaaaatggtccaccagatttttgggtctgcgtacacagccctcttctccggcgtgagctgggtgatgaagatcggaattggcgtcctgcttacctggatcgggctcaattctaagaacacaagcatgtccttttcttgcattgctatcggaatcattacgctgtatctgggcgccgtggttcaggcttga

SEQ ID NO: 2164 - RNA, 2037 nt, synthetic construct
  misc_feature 1..2037: note = derived and/or modified CDS sequence (opt5) from DENV-3 Consensus__SSopt-pr(D104A)ME(F108S,R186L,A265T)
  source 1..2037: mol_type = other RNA
atgaagcggaaaaagaccagcctgtgcctcatgatgatcctgcccgccgctcttgccttccacctgacatcccgggacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgccaagagatctgtggctctggcccctcatgtcgggatgggactggacacccggacacaaacctggatgagcgctgagggcgcctggcgccaggtggaaaaagttgagacatgggcgctcagacaccccggcttcaccatcctggccctttttctggctcattacatcgggacgtccctcacacagaaggtggtcattttcatcctgcttatgctggtgaccccttctatgacaatgcggtgtgttggagtgggcaaccgcgattttgtcgaagggctcagcggagccacctgggtggacgtggtcctggagcacggcgggtgcgttaccacaatggctaaaaataagcccacgctggatattgagctccagaaaaccgaagccacacaactggcgacccttagaaagctgtgtatcgagggaaagattacaaacatcaccacggactcccggtgccctacacagggcgaagccaccctcccggaggaacaggatcagaattatgtgtgtaaacacacctacgtggaccgcggctgggggaacggatgcggcctgagcgggaagggatctcttgtcacatgcgctaaattccaatgtctggagcccattgagggcaaggtggttcagtatgaaaatctcaaatacaccgtgatcatcacagtccatacgggggatcagcaccaggtgggaaacgagacccaaggcgttacagccgaaattacccctcaggcttccacaaccgaggccatcctgcccgaatatggcacgctggggctcgagtgcagccctctgaccggacttgactttaatgagatgattctgctcacaatgaagaacaaagcctggatggtgcatagacagtggttctttgacctgccccttccgtggacctctggcgctacaaccgaaacgcctacatggaatcggaaggagctgctcgtcaccttcaagaacgcgcacgccaaaaagcaagaagtggtcgtgctggggtcccaggagggagctatgcacacagccctgaccggcaccacagaaatccagaatagcgggggcacgtctatttttgccggacatctcaaatgtcgcctgaagatggataaacttgagctgaagggcatgtcctacgctatgtgcaccaacacattcgttctcaagaaagaggtgagcgaaacccagcacgggacaatcctgatcaaggtcgagtacaaaggagaagacgtgccctgtaagattcctttttccaccgaggatggccaagggaaagcccataacggaagactgatcacggcgaatcccgttgtgacaaagaaggaggaacccgtcaacattgaggctgaacctccgttcggcgagtctaatatcgtgattgggatcggcgacaacgcccttaaaatcaattggtataagaaaggaagctccattggcaagatgttcgaagccaccgctagaggggccagacgcatggctatcctcggagataccgcctgggactttggcagcgttgggggagtgctgaactctctgggcaaaatggtccaccagattttcgggtccgcgtacacagccctctttagcggcgtgtcttgggtgatgaagatcggaattggcgtcctgcttacctggatcgggctgaatagcaagaacacatccatgtctttcagctgcattgctatcggaatcattacgctctatctgggcgccgtggttcaggcttga

SEQ ID NO: 2165 - RNA, 2016 nt, synthetic construct
  misc_feature 1..2016: note = derived and/or modified CDS sequence (opt5) from DENV-3 Consensus__SSopt-prMEdel101-107,(R99P,F108N)
  source 1..2016: mol_type = other RNA
atgaagcgcaaaaagaccagcctgtgcctcatgatgatcctgcccgccgctcttgccttccacctgacatcccgggacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcccggcaacgggaagggaagcctggtcacatgcgccaaattccaatgccttgagcctattgagggcaaggtggttcagtatgaaaatctgaaatacaccgtgatcatcacagtccatacgggggaccagcaccaggtgggaaacgagacccaaggcgttacagctgaaattacaccccaggcctctaccaccgaggctatcctccctgaatatgggacgctgggactggagtgttcccccagaaccggcctcgactttaatgagatgattctgcttacaatgaagaacaaagcctggatggtgcatagacagtggttctttgatctgccgctcccttggaccagcggcgccacaaccgaaacgcccacatggaatcggaaggagctgcttgtcaccttcaagaacgctcacgcgaaaaagcaagaagtggtcgtgctggggtctcaggagggagccatgcacacagctctcaccggcgccaccgaaatccaaaattccgggggaacaagcatttttgccggccatctgaaatgccgcctgaagatggacaaactcgagctgaaggggatgtcttacgctatgtgtacgaacaccttcgttcttaagaaagaggtgtccgaaacacagcacggcaccatcctgatcaaggtcgagtacaaaggagaagatgtgccttgcaagattccctttagcacagaggacggccaggggaaagcccataacggaagactcatcaccgcgaatcccgttgtgacgaagaaggaggaacctgtcaacattgaggctgaaccgcccttcggcgagtccaatatcgtgattgggatcggagataacgccctgaaaatcaattggtataagaaaggctctagcattgggaagatgttcgaagccacagctcggggcgccagacgcatggctatcctgggagacaccgcctgggattttggctccgttgggggagtgcttaacagcctcggcaaaatggtccaccagattttcgggtctgcgtacaccgccctgttttccggagtgagctgggtgatgaagatcggcattggggtcctgctcacatggatcggccttaattctaagaacaccagcatgtccttctcttgtattgctatcggaatcattacactgtatctgggcgccgtggttcaggcttga

SEQ ID NO: 2166 - RNA, 2037 nt, synthetic construct
  misc_feature 1..2037: note = derived and/or modified CDS sequence (opt5) from DENV-3 Consensus__SSopt-prMEdelstem_TM-JEV
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaaatgtagactcaagatggacaaactggagcttaagggcatgtcttacgctatgtgcacgaacacctttgttctgaagaaagaggtgtccgaaacacagcacgggaccatcctcatcaaggtcgagtacaaaggagaagatgtgccctgtaagattcctttcagcacagaggacggccaggggaaagcccataacggacggctgatcaccgcgaatcccgttgtgacgaagaaggaggaacccgtcaacattgaggctgaacctccgttcggcgagtccaatatcgtgattgggatcggcgataacgccctgaaaatcaattggtataagaaaggatctacacttggcaaggcctttagcaccaccctcaaaggggctcagagactggccgctctgggagacacagcctgggatttcggctccattgggggagtgtttaacagcatcggccgcgcggttcaccaggtcttcgggggcgcctttcggaccctcttcggaggcatgtcttggattacacaggggctgatgggagcccttctgctctggatgggcgtgaatgctagagaccgctccatcgctctggcctttctggcgaccgggggagtgcttgtcttcctcgccacgaacgtgcatgcttga

SEQ ID NO: 2167 - RNA, 2037 nt, synthetic construct
  misc_feature 1..2037: note = derived and/or modified CDS sequence (opt5) from DENV-3 Consensus__SSopt-pr(D104A)MEdelstem_TM,(F108S)-JEV
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgccaagagatctgtggctctggcccctcatgtcgggatgggactggacacccggacacaaacctggatgagcgctgagggcgcctggcgccaggtggaaaaagttgagacatgggcgctcagacaccccggcttcaccatcctggccctttttctggctcattacatcgggacgtccctcacacagaaggtggtcattttcatcctgcttatgctggtgaccccttctatgacaatgcggtgtgttggagtgggcaaccgcgattttgtcgaagggctcagcggagccacctgggtggacgtggtcctggagcacggcgggtgcgttaccacaatggctaaaaataagcccacgctggatattgagctccagaaaaccgaagccacacaactggcgacccttagaaagctgtgtatcgagggaaagattacaaacatcaccacggactcccggtgccctacacagggcgaagccaccctcccggaggaacaggatcagaattatgtgtgtaaacacacctacgtggaccgcggctgggggaacggatgcggcctgagcgggaagggatctcttgtcacatgcgctaaattccaatgtctggagcccattgagggcaaggtggttcagtatgaaaatctcaaatacaccgtgatcatcacagtccatacgggggatcagcaccaggtgggaaacgagacccaaggcgttacagccgaaattacccctcaggcttccacaaccgaggccatcctgcccgaatatggcacgctggggctcgagtgcagccctagaaccggactggactttaatgagatgattcttctgacaatgaagaacaaagcctggatggtgcatcggcagtggttctttgacctccccctgccgtggacctctggcgctacaaccgaaacgcctacatggaatcgcaaggagcttctggtcaccttcaagaacgcgcacgccaaaaagcaagaagtggtcgtgctcgggtcccaggagggagctatgcacacagccctgaccggcgccaccgaaatccagaatagcgggggcacatctatttttgctggacatctgaaatgtagactcaagatggataaactggagcttaagggcatgtcctacgccatgtgcacgaacaccttcgttctgaagaaagaggtgagcgaaacacagcacgggaccatcctcatcaaggtcgagtacaaaggagaagacgtgccctgtaagattcctttttccacagaggatggccaagggaaagcgcataacggacggctgatcaccgctaatcccgttgtgacgaagaaggaggaacccgtcaacattgaggccgaacctccgttcggcgagtctaatatcgtgattgggatcggcgacaacgccctgaaaatcaattggtataagaaaggaagcacacttggcaaggctttctccaccaccctcaaaggggcccagagactggctgccctgggagatacagcgtgggactttggcagcattgggggagtgttcaactctatcggccgcgccgttcaccaggtctttgggggcgctttccggaccctctttggaggcatgtcctggattacacaggggctgatgggagcccttctgctctggatgggcgtgaatgctagagatcgcagcatcgccctggcgttcctggccaccgggggagtgcttgtctttctcgctacgaacgtgcatgcctga

SEQ ID NO: 2168 - RNA, 2037 nt, synthetic construct
  misc_feature 1..2037: note = derived and/or modified CDS sequence (opt5) from DENV-3 Consensus__SSopt-pr(D104A)MEdelstem_TM,(R186L,A265T)-JEV
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgccaagagatctgtggctctggcccctcatgtcgggatgggactggacacccggacacaaacctggatgagcgctgagggcgcctggcgccaggtggaaaaagttgagacatgggcgctcagacaccccggcttcaccatcctggccctttttctggctcattacatcgggacgtccctcacacagaaggtggtcattttcatcctgcttatgctggtgaccccttctatgacaatgcggtgtgttggagtgggcaaccgcgattttgtcgaagggctcagcggagccacctgggtggacgtggtcctggagcacggcgggtgcgttaccacaatggctaaaaataagcccacgctggatattgagctccagaaaaccgaagccacacaactggcgacccttagaaagctgtgtatcgagggaaagattacaaacatcaccacggactcccggtgccctacacagggcgaagccaccctcccggaggaacaggatcagaattatgtgtgtaaacacacctacgtggaccgcggctgggggaacggatgcggcctgttcgggaagggaagccttgtcacatgcgctaaatttcaatgtctggagcccattgagggcaaggtggttcagtatgaaaatctcaaatacaccgtgatcatcacagtccatacgggggatcagcaccaggtgggaaacgagacccaaggcgttacagccgaaattacccctcaggcttctacaaccgaggccatcctgcccgaatatggcacgctggggctcgagtgctcccctctgaccggacttgacttcaatgagatgattctgctcacaatgaagaacaaagcctggatggtgcatagacagtggtttttcgacctgccccttccgtggaccagcggcgctacaaccgaaacgcctacatggaatcggaaggagctgctcgtcacctttaagaacgcgcacgccaaaaagcaagaagtggtcgtgctggggtctcaggagggagctatgcacacagccctgaccggcaccacagaaatccaaaattccgggggcacgagcattttcgccggacatctcaaatgtcgcctgaagatggataaacttgagctgaagggcatgtcttacgctatgtgcaccaacacatttgttctcaagaaagaggtgtccgaaacccagcacgggacaatcctgatcaaggtcgagtacaaaggagaagacgtgccctgtaagattcctttcagcaccgaggatggccaggggaaagcccataacggaagactgatcacggcgaatcccgttgtgacaaagaaggaggaacccgtcaacattgaggctgaacctccgttcggcgagtccaatatcgtgattgggatcggcgacaacgcccttaaaatcaattggtataagaaaggatctaccctcggcaaggcctttagcaccacactgaaaggggctcagcggctggccgctctcggagataccgcctgggacttcggctccattgggggagtgtttaacagcatcggcagagcggttcaccaggtcttcgggggcgcctttcgcacactgttcggaggcatgtcttggattacgcaggggcttatgggagctctgctcctgtggatgggcgtgaatgcccgggatagatccatcgctctggcctttcttgcgaccgggggagtgctcgtcttcctggccacaaacgtgcatgcttga

SEQ ID NO: 2169 - RNA, 2037 nt, synthetic construct
  misc_feature 1..2037: note = derived and/or modified CDS sequence (opt5) from DENV-3 Consensus__SSopt-pr(D104A)MEdelstem_TM,(F108S,R186L,A265T)- JEV
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgccaagagatctgtggctctggcccctcatgtcgggatgggactggacacccggacacaaacctggatgagcgctgagggcgcctggcgccaggtggaaaaagttgagacatgggcgctcagacaccccggcttcaccatcctggccctttttctggctcattacatcgggacgtccctcacacagaaggtggtcattttcatcctgcttatgctggtgaccccttctatgacaatgcggtgtgttggagtgggcaaccgcgattttgtcgaagggctcagcggagccacctgggtggacgtggtcctggagcacggcgggtgcgttaccacaatggctaaaaataagcccacgctggatattgagctccagaaaaccgaagccacacaactggcgacccttagaaagctgtgtatcgagggaaagattacaaacatcaccacggactcccggtgccctacacagggcgaagccaccctcccggaggaacaggatcagaattatgtgtgtaaacacacctacgtggaccgcggctgggggaacggatgcggcctgagcgggaagggatctcttgtcacatgcgctaaattccaatgtctggagcccattgagggcaaggtggttcagtatgaaaatctcaaatacaccgtgatcatcacagtccatacgggggatcagcaccaggtgggaaacgagacccaaggcgttacagccgaaattacccctcaggcttccacaaccgaggccatcctgcccgaatatggcacgctggggctcgagtgcagccctctgaccggacttgactttaatgagatgattctgctcacaatgaagaacaaagcctggatggtgcatagacagtggttctttgacctgccccttccgtggacctctggcgctacaaccgaaacgcctacatggaatcggaaggagctgctcgtcaccttcaagaacgcgcacgccaaaaagcaagaagtggtcgtgctggggtcccaggagggagctatgcacacagccctgaccggcaccacagaaatccagaatagcgggggcacgtctatttttgccggacatctcaaatgtcgcctgaagatggataaacttgagctgaagggcatgtcctacgctatgtgcaccaacacattcgttctcaagaaagaggtgagcgaaacccagcacgggacaatcctgatcaaggtcgagtacaaaggagaagacgtgccctgtaagattcctttttccaccgaggatggccaagggaaagcccataacggaagactgatcacggcgaatcccgttgtgacaaagaaggaggaacccgtcaacattgaggctgaacctccgttcggcgagtctaatatcgtgattgggatcggcgacaacgcccttaaaatcaattggtataagaaaggaagcaccctcggcaaggccttctccaccacactgaaaggggctcagcggctggccgctctcggagataccgcctgggactttggcagcattgggggagtgttcaactctatcggcagagcggttcaccaggtctttgggggcgccttccgcacactgtttggaggcatgtcctggattacgcaggggcttatgggagctctgctcctgtggatgggcgtgaatgcccgggatagaagcatcgctctggccttccttgcgaccgggggagtgctcgtctttctggccacaaacgtgcatgcttga

SEQ ID NO: 2170 - RNA, 2037 nt, synthetic construct
  misc_feature 1..2037: note = derived and/or modified CDS sequence (opt5) from DENV-3 Consensus__SSopt-prMEdelstem_TM,(H259N)-JEV
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctagaaccggactggacttcaatgagatgattcttctgacaatgaagaacaaagcctggatggtgcatcggcagtggtttttcgatctccccctgccgtggaccagcggcgccacaaccgaaacgcctacatggaatcgcaaggagcttctggtcacctttaagaacgctcacgcgaaaaagcaagaagtggtcgtgctcgggtctcaggagggagccatgaatacagctctgaccggcgccaccgaaatccagaactccgggggcacaagcattttcgccggacacctgaaatgtagactcaagatggacaaactggagcttaagggcatgtcttacgctatgtgcacgaacacctttgttctgaagaaagaggtgtccgaaacacagcatgggaccatcctcatcaaggtcgagtacaaaggagaagatgtgccctgtaagattcctttcagcacagaggacggccaagggaaagcccacaatggacggctgatcaccgcgaaccccgttgtgacgaagaaggaggaacccgtcaatattgaggctgaacctccgttcggcgagtccaacatcgtgattgggatcggcgataatgccctgaaaatcaactggtataagaaaggatctacacttggcaaggcctttagcaccaccctcaaaggggctcagagactggccgctctgggagacacagcctgggatttcggctccattgggggagtgtttaatagcatcggccgcgcggttcatcaggtcttcgggggcgcctttcggaccctcttcggaggcatgtcttggattacacaggggctgatgggagcccttctgctctggatgggcgtgaacgctagagaccgctccatcgctctggcctttctggcgaccgggggagtgcttgtcttcctcgccacgaatgtgcacgcttga

SEQ ID NO: 2171 - RNA, 2037 nt, synthetic construct
  misc_feature 1..2037: note = derived and/or modified CDS sequence (opt5) from DENV-3 Consensus__SSopt-prMEdelstem_TM,(R186L,A265T)-JEV
  source 1..2037: mol_type = other RNA
atgaagcggaaaaagaccagcctgtgcctcatgatgatcctgcccgccgctcttgccttccacctgacatccagagacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcgcggctgggggaacggatgcggcctgttcgggaagggaagccttgtcacatgcgccaaatttcaatgtctggagcccattgagggcaaggtggttcagtatgaaaatctcaaatacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctctgaccggacttgacttcaatgagatgattctgctcacaatgaagaacaaagcctggatggtgcatagacagtggtttttcgatctgccccttccgtggaccagcggcgccacaaccgaaacgcctacatggaatcggaaggagctgctcgtcacctttaagaacgctcacgcgaaaaagcaagaagtggtcgtgctggggtctcaggagggagccatgcacacagctctgaccggcaccacagaaatccaaaattccgggggcacgagcattttcgccggacatctcaaatgtcgcctgaagatggacaaacttgagctgaagggcatgtcttacgccatgtgcaccaacacatttgttctcaagaaagaggtgtccgaaacccagcacgggacaatcctgatcaaggtcgagtacaaaggagaagatgtgccctgtaagattcctttcagcaccgaggacggccaggggaaagctcataacggaagactgatcacggccaatcccgttgtgacaaagaaggaggaacccgtcaacattgaggcggaacctccgttcggcgagtccaatatcgtgattgggatcggcgataacgctcttaaaatcaattggtataagaaaggatctaccctcggcaaggcctttagcaccacactgaaaggggcccagcggctggctgccctcggagacaccgcttgggatttcggctccattgggggagtgtttaacagcatcggcagagccgttcaccaggtcttcgggggcgcgtttcgcacactgttcggaggcatgtcttggattacgcaggggcttatgggagccctgctcctgtggatgggcgtgaatgctcgggacagatccatcgccctggcttttcttgccaccgggggagtgctcgtcttcctggcgacaaacgtgcatgcctga

SEQ ID NO: 2172 - RNA, 2016 nt, synthetic construct
  misc_feature 1..2016: note = derived and/or modified CDS sequence (opt5) from DENV-3 Consensus__SSopt-prMEdelstem_TM,del101-107,(R99P,F108N)-JEV
  source 1..2016: mol_type = other RNA
atgaagcgcaaaaagaccagcctgtgcctcatgatgatcctgcccgccgctcttgccttccacctgacatcccgggacggcgagcctcgcatgattgtggggaaaaacgaaagaggaaagtctctcctgtttaaaacggcgagcggcatcaatatgtgtacccttattgctatggatctgggggagatgtgcgacgatacagtcacctacaagtgtccgcatatcacagaagttgagcccgaagacattgattgctggtgtaacctcacctccacatgggtgacctatggaacgtgcaatcaggccggcgagcaccggcgcgacaagagatctgtggccctggctcctcatgtcgggatgggactggatacccggacacaaacctggatgagcgccgagggcgcttggcgccaggtggaaaaagttgagacatgggccctcagacaccccggcttcaccatcctggcgctttttctggcccattacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcacggcgggtgcgttaccacaatggccaaaaataagcccacgctggacattgagctccagaaaaccgaagctacacaactggccacccttagaaagctgtgtatcgagggaaagattacaaacatcaccacggattcccggtgccctacacagggcgaagcgaccctcccggaggaacaggaccagaattatgtgtgtaaacacacctacgtggatcccggcaacgggaagggaagcctggtcacatgcgccaaattccaatgccttgagcctattgagggcaaggtggttcagtatgaaaatctgaaatacaccgtgatcatcacagtccatacgggggaccagcaccaggtgggaaacgagacccaaggcgttacagctgaaattacgccccaggcctctacaaccgaggctatcctccctgaatatgggacgctgggactggagtgttcccccagaaccggcctcgactttaatgagatgattctgcttacaatgaagaacaaagcctggatggtgcatagacagtggttctttgatctgccgctcccttggaccagcggcgccacaaccgaaacgcccacatggaatcggaaggagctgcttgtcaccttcaagaacgctcacgcgaaaaagcaagaagtggtcgtgctggggtctcaggagggagccatgcacacagctctcaccggcgccaccgaaatccaaaattccgggggaacaagcatttttgccggccatctgaaatgccgcctgaagatggacaaactcgagctgaaggggatgtcttacgctatgtgtacgaacaccttcgttcttaagaaagaggtgtccgaaacacagcacggcaccatcctgatcaaggtcgagtacaaaggagaagatgtgccttgcaagattccctttagcacagaggacggccaggggaaagcccataacggaagactcatcaccgcgaatcccgttgtgacgaagaaggaggaacctgtcaacattgaggctgaaccgcccttcggcgagtccaatatcgtgattgggatcggagataacgccctgaaaatcaattggtataagaaaggctctacactggggaaggccttcagcaccacccttaaaggcgctcagcggctcgccgctctgggagacacagcctgggattttggctccattgggggagtgttcaacagcatcggcagagcggttcaccaggtctttgggggagccttccgcaccctgtttggcgggatgtcttggattacacagggcctcatgggagctctgcttctgtggatgggcgtgaatgcccgggacagatccatcgctctcgccttcctggcgaccgggggagtgctggtctttcttgccaccaacgtgcatgcttga

SEQ ID NO: 2173 - RNA, 3081 nt, synthetic construct
  misc_feature 1..3081: note = derived and/or modified CDS sequence (opt5) from DENV-3 Consensus__SSc-prME-NS1
  source 1..3081: mol_type = other RNA
atgaccagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcgccaggtggaaaaagttgagacatgggccctccggcaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcgaccctcccggaggaacaggaccagaattatgtgtgtaaacacacctacgtggatcggggctgggggaacggatgcggcctgttcgggaagggaagccttgtcacatgcgccaagtttcaatgtctggagcccattgagggcaaagtggttcagtatgaaaatctcaagtacaccgtgatcatcacagtccatacgggggaccagcaccaggtgggaaacgagacccaaggcgttacagctgaaattacccctcaggcctctacaaccgaggctatcctgcccgaatatggcacgctggggctcgagtgctcccctcgcaccggactggacttcaatgagatgattcttctgacaatgaaaaacaaggcctggatggtgcatagacagtggtttttcgatctccccctgccgtggaccagcggcgccacaaccgaaacgcctacatggaatcggaaagagcttctggtcacctttaagaacgctcacgcgaaaaagcaagaagtggtcgtgctcgggtctcaggagggagccatgcacacagctctgaccggcgccaccgaaatccaaaattccgggggcacaagcattttcgccggacatctgaagtgtcgcctcaaaatggacaagctggagcttaaaggcatgtcttacgctatgtgcacgaacacctttgttctgaagaaagaggtgtccgaaacacagcacgggaccatcctcatcaaggtcgagtacaagggagaagatgtgccctgtaaaattcctttcagcacagaggacggccaggggaaggcccataacggaagactgatcaccgcgaatcccgttgtgacgaaaaaggaggaacccgtcaacattgaggctgaacctccgttcggcgagtccaatatcgtgattgggatcggcgataacgccctgaaaatcaattggtataagaagggatctagcattggcaaaatgtttgaagccacagctagaggggcccggcgcatggctatccttggagacaccgcctgggatttcggctccgttgggggagtgctcaacagcctgggcaagatggtccaccagatttttgggtctgcgtacaccgccctgttctccggcgtgagctgggtgatgaaaatcggaattggcgtcctcctgacatggatcgggcttaattctaagaacaccagcatgtccttttcttgcattgctatcggaatcattacactgtatctcggcgccgtggttcaggctgacatggggtgtgtgatcaattggaaaggaaaggagctgaagtgcggcagcgggattttcgtcacgaacgaggtgcatacctggacagaacagtacaaatttcaagccgattcccccaagcggctggcgaccgccatcgctggcgcctgggagaatggagtttgtggcattagaagcacaacccgcatggaaaaccttctctggaaacagatcgctaatgagctgaactatatcctgtgggaaaataacattaagctcacggtggtcgtgggggacatcattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgtctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaaccatcgccccggatatcacacccaaacggccggcccttggcaccttgggaagctggagctcgactttaattactgcgagggaacaaccgttgtgatcacagaaaactgtggcacccggggcccctctctgagaacaaccacggtctccgggaaactgatccatgagtggtgctgtcgcagctgcacccttccgcctctccggtatatgggagaagatggctgttggtacgggatggagattagacccatctctgaaaaggaggagaatatggtgaaatccctggttagcgcgtga

SEQ ID NO: 2174 - RNA, 1824 nt, synthetic construct
  misc_feature 1..1824: note = derived and/or modified CDS sequence (opt5) from DENV-3 Consensus__SSm-EdelTM-linker-ferritin
  source 1..1824: mol_type = other RNA
atgacccagaaggtggtcatcttcattctgctcatgctggttacacccagcatgacgatgagatgcgtgggcgtggggaaccgggactttgtcgagggactttccggcgccacctgggtggatgttgtgctggaacacgggggatgtgtcacaaccatggctaaaaataagcctacactcgacatcgagctgcagaaaaccgaagccacacagcttgcgaccctgcgcaagctctgcattgagggcaaaatcacgaacattaccacagattctagatgtccgacccagggggaagctacactgcccgaggagcaggaccaaaattacgtgtgcaagcatacctatgttgatcggggatggggcaacggctgtgggctgttcggaaagggcagcctcgtgacgtgcgccaaatttcagtgtctggaacctatcgaggggaaggtcgtgcagtacgaaaatcttaaatatacagtgatcattaccgtccacacaggagaccagcatcaagttggcaacgagacccagggggtgaccgccgagatcacaccccaggcttccacgaccgaagccattctgcctgagtacggaacactcggcctggaatgctctccccgcaccggccttgatttcaatgagatgatcctgctcacaatgaagaacaaggcttggatggtgcacagacagtggtttttcgacctgcctctgccgtggaccagcggggccacgacagaaacccccacctggaatcggaaagagctcctggtcacatttaagaacgcgcatgccaaaaagcaagaggtggttgtgcttggatcccaggaaggcgctatgcacaccgccctgacaggggctacggagattcaaaattctggaggcaccagcatcttcgccgggcacctcaaatgtcgcctgaagatggataaacttgaactgaagggaatgtcctatgcgatgtgcacaaacacctttgtcctcaaaaaggaggtgagcgaaacacaacatggcaccattctgatcaaggttgagtacaaaggcgaggacgtgccttgtaagatccccttctctacggaagatgggcagggaaaagcccacaatggcagactgattaccgctaaccctgtcgtgacaaagaaagaggaacccgtcaatatcgaggccgaaccgccttttggggagtccaacattgtgatcggaattggcgacaacgctctcaagatcaattggtataagaaagggagctctatcggcaagatgttcgaggccaccgcccggggagctcgcagaatggcgattctgggcgatacagcctgggactttgggtccagcggaggcgacatcattaaacttctgaacgaacaggttaataaggagatgcagtcttccaacctctacatgagcatgtcctcttggtgctacacccatagcctggatggggctggacttttcctgttcgaccacgccgccgaagagtatgagcacgctaaaaagctcatcatttttctgaatgaaaacaatgtgcccgtccaactgacgtccatcagcgcccctgagcataagttcgaaggcctcacacagatctttcagaaagcgtacgagcacgaacagcatatttctgagtccatcaacaatattgtggatcacgctatcaagagcaaagaccatgccaccttcaactttctgcaatggtatgttgccgagcagcacgaagaggaagtgcttttcaaggatattctggacaaaatcgagctcattgggaatgaaaaccacggcctgtacctggctgatcagtatgtcaagggaatcgccaagtctcggaaaagctga

SEQ ID NO: 2175 - RNA, 1821 nt, synthetic construct
  misc_feature 1..1821: note = derived and/or modified CDS sequence (opt5) from DENV-3 Consensus__SStPA-WHbcAg-linker-EdelTM
  source 1..1821: mol_type = other RNA
atggacgccatgaagagaggcctgtgctgtgtgctcctgctttgcggggctgtcttcgttgatagcgtgaccggaatggacatcgatccctacaaagagtttggctcctcttatcagctgctcaacttcctgcctcttgactttttcccggatctgaatgccctcgtggacacagcgacggctctgtacgaagaggaactgaccgggcgggagcactgtagcccccatcacacagccattcgccaagccctcgtctgctgggatgaactgaccaaacttatcgcttggatgtcctctaacattacaagcgaacaggtgagaaccatcattgttaatcatgtgaacgacacatggggactgaaagtccggcagtccctctggtttcacctgtcttgtcttaccttcggccagcatacggtgcaagagtttctggttagcttcggggtgtggatccgcacccctgccccctatagacctcccaatgctcctatcctctccacactgccggaacacaccgtcatttgcggaggcggcgggagcggaggcgggggaatgcggtgtgtgggcgtggggaaccgcgattttgtcgagggactgtctggcgccacatgggttgacgtggtgctcgaacacggcgggtgcgtcaccacgatggcgaagaataaacccacactggatatcgagcttcagaagaccgaggccacacagctggctaccctcagaaagctgtgtattgaaggaaaaatcaccaacattacaacggactcccggtgccctacccagggcgaggccacacttcccgaggagcaagatcagaattacgtgtgtaagcatacctatgttgaccgcgggtggggaaacggctgcgggctgttcggaaaaggcagcctcgtgacatgcgctaagtttcagtgtctggaacctatcgagggcaaagtcgtgcagtacgagaatctgaagtataccgttattatcacggtgcacacaggggaccaacatcaggtcggaaacgaaacccagggcgtgaccgccgagatcacaccccaagcgtctaccacagaagccattctcccggagtacgggacgctgggacttgaatgctcccctagaaccggcctggatttcaatgagatgatcctcctgacaatgaagaacaaggcttggatggtccaccggcagtggtttttcgaccttcccctgccttggaccagcggggccacaaccgagacgcccacctggaatcgcaaggaactcctggtgacattcaaaaacgctcacgccaagaaacaggaggttgtggtcctgggctctcaggaaggagccatgcataccgctctcacaggcgcgaccgagattcaaaactccgggggaacgagcatctttgccggccacctgaagtgtagacttaaaatggataagctggaactcaaggggatgtcctacgctatgtgcacaaataccttcgtgctgaaaaaggaggtttctgagacacagcatggaaccattctgatcaaagtggaatataagggcgaggacgtcccctgtaaaatcccttttagcaccgaagatgggcagggcaaggcccacaacggacggcttattacagccaatccggtggtgacgaagaaagaggagcccgttaacatcgaagctgagcctcccttcggcgaatccaatattgtcatcgggattggagacaacgccctcaagatcaattggtacaaaaagggcagctctatcgggaaaatgtttgaggcgaccgctcgcggagccagacggatggccattctgggcgatacagcttgggacttcgggtcctga

SEQ ID NO: 2176 - RNA, 75 nt, synthetic construct
  misc_feature 1..75: note = derived and/or modified CDS sequence (opt6) from Homo sapiens__SigSeq(TPA)/SStPA
  source 1..75: mol_type = other RNA
atggatgcaatgaaaagaggattatgttgtgtattattattatgtggagcagtatttgtagatagtgtgacaggg

SEQ ID NO: 2177 - RNA, 489 nt, synthetic construct
  misc_feature 1..489: note = derived and/or modified CDS sequence (opt6) from Helicobacter pylori J99__Ferritin
  source 1..489: mol_type = other RNA
gacataataaaactactaaacgaacaagtaaacaaagaaatgcaatcaagcaacctctacatgtcaatgtcatcatggtgctacacacactcactagacggagcaggactattcttattcgaccacgcagcagaagaatacgaacacgcaaaaaaactaataatattcctaaacgaaaacaacgtaccagtacaactaacatcaatatcagcacccgaacacaaattcgaaggactaacacaaatattccaaaaagcatacgaacacgaacaacacatatcagaatcaataaacaacatagtagaccacgcaataaaatcaaaagaccacgcaacattcaacttcttacaatggtacgtagcagaacaacacgaagaagaagtactattcaaagacatactagacaaaatagaactaataggaaacgaaaaccatggactatacctagcagaccaatacgtcaaaggaatagcaaaatcaagaaaatca

SEQ ID NO: 2178 - RNA, 450 nt, synthetic construct
  misc_feature 1..450: note = derived and/or modified CDS sequence (opt6) from Woodchuck hepatitis virus__WHbcAg
  source 1..450: mol_type = other RNA
atggacatagacccatacaaagaattcggatcatcataccaactactaaacttcctaccactagacttctttccagacctaaacgccctagtagacacagcaacagcattatacgaagaagaactaacaggaagagaacactgctcaccacaccacacagcaataagacaagcactagtatgctgggacgaactaacaaaactaatagcatggatgtcatcaaacataacatcagaacaagtaagaacaataatagtaaaccacgtaaacgacacatggggattaaaagtaagacaatcattatggttccacctatcctgcctaacattcggacaacacacagtacaagaattcctagtatcattcggagtatggataagaacaccagcaccatacagaccaccaaacgcaccaatactatcaacactaccagaacacacagtaatatgc

SEQ ID NO: 2179 - RNA, 303 nt, synthetic construct
  misc_feature 1..303: note = derived and/or modified CDS sequence (opt6) from Japanese encephalitis virus__Cterm-JEV/JEV
  source 1..303: mol_type = other RNA
ggaagtacattaggaaaagcattttcaacaacattaaaaggagcacaaagattagcagcattaggagatacagcatgggattttggaagtataggaggagtatttaattcaataggaagagcagtacatcaagtatttggaggagcatttagaacattatttggaggaatgagttggataacacaaggattaatgggagcattattattatggatgggagtaaatgcaagagatagaagtatagcattagcatttttagcaacaggaggagtattagtatttttagcaacaaatgtacatgca

SEQ ID NO: 2180 - RNA, 15 nt, synthetic construct
  misc_feature 1..15: note = derived and/or modified CDS sequence (opt6) from Artificial__MKRKK
  source 1..15: mol_type = other RNA
atgaagagaaagaag

SEQ ID NO: 2181 - skipped

SEQ ID NO: 2182 - RNA, 27 nt, synthetic construct
  misc_feature 1..27: note = derived and/or modified CDS sequence (opt6) from Artificial__Linker(G4SG4)
  source 1..27: mol_type = other RNA
ggggggggggggagtggagggggaggg

SEQ ID NO: 2183 - RNA, 51 nt, synthetic construct
  misc_feature 1..51: note = derived and/or modified CDS sequence (opt6) from Foot-and-mouth disease virus__F2A/P2A
  source 1..51: mol_type = other RNA
aactttgacttactaaaactagcaggagatgtagaaagcaatccaggacca

SEQ ID NO: 2184 - RNA, 300 nt, synthetic construct
  misc_feature 1..300: note = derived and/or modified CDS sequence (opt6) from DENV-1 CYD23__C
  source 1..300: mol_type = other RNA
atgaacaaccaaagaaaaaaaacagcaagaccaagcttcaacatgctaaaaagagcaagaaacagagtaagtacagtatcacaactagcaaaaagattcagcaaaggactactatcaggacaaggaccaatgaaactagtaatggcattcatagcattcctaagattcctagcaataccaccaacagcaggaatactagcaagatggggatcattcaaaaaaaacggagcaataaaagtactaagaggattcaaaaaagaaatatcaaacatgctaaacataatgaacagacgaagaaaa

SEQ ID NO: 2185 - RNA, 342 nt, synthetic construct
  misc_feature 1..342: note = derived and/or modified CDS sequence (opt6) from DENV-1 CYD23__C-SSc
  source 1..342: mol_type = other RNA
atgaacaaccaaagaaaaaaaacagcaagaccaagcttcaacatgctaaaaagagcaagaaacagagtaagcacagtatcacaattagcaaaacgattcagcaaaggactactatcaggacaaggaccaatgaaactagtaatggcattcatagcattcctaagattcctagcaataccaccaacagcaggaatactagcaagatggggatcattcaaaaaaaacggagcaataaaagtactaagaggattcaaaaaagaaatatcaaacatgctaaacataatgaacagaagaagaaaatcagtaacaatgctactaatgctaatgccaacagcactagca

SEQ ID NO: 2186 - RNA, 273 nt, synthetic construct
  misc_feature 1..273: note = derived and/or modified CDS sequence (opt6) from DENV-1 CYD23__pr
  source 1..273: mol_type = other RNA
tttcacttaacaacaagaggaggagaaccacatatgatagtatcaaaacaagaaagaggaaaaagtctattatttaaaacaagtgcaggagtaaatatgtgcacactaatagcaatggacttaggagaactatgtgaagacacaatgacatataaatgcccaagaataacagaagcagaaccagacgatgtagactgctggtgcaatgcaacagacacatgggtaacatacggaacatgctcacaaacaggagaacacagaagagacaaaaga

SEQ ID NO: 2187 - RNA, 225 nt, synthetic construct
  misc_feature 1..225: note = derived and/or modified CDS sequence (opt6) from DENV-1 CYD23__M
  source 1..225: mol_type = other RNA
agcgtagcattagcaccacacgtaggattaggattagaaacaagaacagaaacatggatgagctcagaaggagcatggaaacaaatacaaagagtagaaacatgggcactaagacacccaggatttacagtaatagcactatttctagcacacgcaataggaacatcaataacacaaaaaggaataatatttatattactaatgctagtaacaccaagcatggca

SEQ ID NO: 2188 - RNA, 498 nt, synthetic construct
  misc_feature 1..498: note = derived and/or modified CDS sequence (opt6) from DENV-1 CYD23__prM
  source 1..498: mol_type = other RNA
ttccacttaaccacaagaggaggagaaccacacatgatagtatcaaaacaagaaagaggaaaatcattattattcaaaacaagcgcaggagtaaacatgtgcacattaatagcaatggacttaggagaattatgtgaagatacaatgacatataaatgtccaagaataacagaagcagaaccagacgatgtagattgctggtgcaatgcaacagacacatgggtaacatatggaacatgcagccaaacgggagaacacagaagagataaaagaagtgtagcattagcaccacacgtaggattaggattagaaacaagaacagaaacatggatgagctcagaaggagcatggaaacaaatacaaagagtagaaacatgggcactaagacacccaggatttacagtaatagcattatttctagcacacgcaataggaacaagtataacacaaaaaggcataatatttatattactaatgctagtaacaccaagtatggca

SEQ ID NO: 2189 - RNA, 1485 nt, synthetic construct
  misc_feature 1..1485: note = derived and/or modified CDS sequence (opt6) from DENV-1 CYD23__E
  source 1..1485: mol_type = other RNA
atgcgatgtgtaggaataggaagtagagattttgtagaaggtctaagcggagcaacatgggtagacgtagtactagaacatggatcatgtgtaactactatggcaaaagataaacctacattagacatagagttactaaaaacagaagtaactaatccagcagtattacgaaaactctgcatagaagcaaaaatatcaaacactacaacagattcaaggtgtccaacacaaggagaagcaactctagtcgaagaacaagacgcaaacttcgtatgcagaagaacatttgtggatagaggatggggaaatggttgtggcctatttggaaaaggatcattaataacatgtgcaaaatttaaatgtgtaacaaaacttgaaggaaaaatagtacaatacgaaaatcttaaatattctgttatagttacagtacacacaggagatcaacaccaagtaggaaacgagtcaacagaacatggaactactgcaacaattaccccacaagctccaacaacagaaatccaattgactgattacggagcattaacattagattgttcaccaagaacaggtttagactttaatgaaatggtattactaacaatgaaagaaaaatcatggttagtacataaacaatggtttttagatctaccattaccctggacatcaggagcctcaacaagtcaagaaacatggaatagacaagatttgctagtaacattcaaaacagcacatgcaaagaaacaagaagttgtagtgttaggaagtcaagaaggagcaatgcacacagctttaacaggagccacagaaatacaaacatcaggaactacaacaattttcgcaggacatttaaaatgtcgactaaaaatggacaaattaacacttaaaggcatgtcatatgtaatgtgtacaggaagttttaaattagaaaaagaagtagcagaaacccaacacggaacagtcctagtacaaataaaatatgaagggactgatgcaccctgcaaaatacctttctcaacacaggatgaaaaaggagtaacacaaaacggtagactaataacagcaaacccaattgtaacagacaaagaaaaacctgtaaatatagaagcagaaccaccgttcggagaatcatatattgtaataggagccggtgaaaaagcattaaaactaagttggttcaaaaagggctcaagtatcggaaaaatgtttgaagcaacagcaagaggcgcaagaagaatggcaatactcggtgatacagcatgggatttcggaagtataggaggagtattcacttcagtaggaaaattagtacatcaaatttttggaacagcatacggagtattattttcaggagtaagttggacaatgaaaataggtataggagtattattaacctggctaggactaaactcaagaagcacgagcttaagtatgacatgtatagcagtaggattagtaaccctatatttaggagtaatggtacaagca

SEQ ID NO: 2190 - RNA, 1983 nt, synthetic construct
  misc_feature 1..1983: note = derived and/or modified CDS sequence (opt6) from DENV-1 CYD23__prME
  source 1..1983: mol_type = other RNA
ttccatctaactacgagaggaggagagcctcacatgatcgtatcaaaacaagaaaggggaaaaagtttattattcaaaacatcagcaggagtaaatatgtgtactctaattgcaatggatttaggagaactatgtgaagatactatgacctataaatgcccaagaataactgaagcagaaccagatgacgtagattgttggtgcaacgcaacagatacatgggtaacgtatggtacttgttcacaaacaggagaacacagaagagataaacgttctgtagcactagcaccacacgttggtttaggattagaaacacgaaccgaaacttggatgagtagtgaaggagcatggaaacaaatacaaagagtagaaacatgggcgttaaggcatcccgggttcactgtaatagcattgtttctagcacatgcaataggaacaagtataacccaaaaaggaataattttcatattattaatgctagtaacaccaagcatggcaatgcgatgtgtcggcataggttccagagattttgtagaaggtctgagtggagcaacttgggttgatgtagttctagaacacggctcatgcgtaactacaatggcaaaagacaaaccaacattagacattgaattactaaaaacagaagttacaaatccagctgttctcagaaaattatgtatagaagcaaaaatatctaacactacaactgattcgagatgtcctacacaaggtgaagccacattagtagaagaacaagacgcaaattttgtatgtagaagaacatttgtcgacagaggatggggaaacggctgcggattatttggtaaaggaagcctaataacatgtgcaaaattcaaatgcgtaacaaaattagaaggaaaaattgtacagtatgaaaacttaaaatatagtgtaatagtgacagtacacacgggagaccaacatcaagtaggtaatgaatcaacagaacatggaacaacagctacaattacaccacaagcacctactacagaaatacagctaactgattatggagctttgacattagattgcagtccaagaacgggtttagattttaatgagatggtattattaactatgaaagaaaaatcatggttagtacacaaacaatggttcttagatctaccattaccatggacatcaggagcctcaacctcacaagaaacatggaacagacaagacttattagtcacatttaaaacagcacatgcaaagaaacaagaagtggtagtactaggatcacaagaaggagcaatgcacactgctttaacaggagccacagaaatacaaacttcaggtactactaccatattcgccggacacttaaaatgtcggttaaaaatggataaactaactttaaaaggaatgagttatgttatgtgcacagggtcattcaagctagaaaaagaagtagctgaaacacaacatggcacagtattagtacaaataaaatacgaaggcactgacgcaccatgcaaaattccattttctacacaagacgaaaaaggagtaacacaaaatggaagattaatcacagcgaatccaatagttacagataaagaaaaaccagtaaacatagaagcagaaccgccttttggagaaagttacatagttattggggcaggagaaaaagcactaaagttgagttggttcaagaaaggaagttcaataggaaaaatgtttgaggcaacggcaagaggcgctcgaagaatggcgatcttaggagataccgcctgggatttcggaagtattggcggggtctttacatcagtaggaaaattagtacatcaaatatttggaacagcctatggggtcttatttagcggagtaagttggaccatgaaaataggaattggagtattactaacctggctgggattaaatagtagatcaacaagtttgagtatgacgtgcatagctgtaggtctagtaacattatatctaggagtgatggtacaggca

SEQ ID NO: 2191 - RNA, 2025 nt, synthetic construct
  misc_feature 1..2025: note = derived and/or modified CDS sequence (opt6) from DENV-1 CYD23__SSc-prME
  source 1..2025: mol_type = other RNA
tcagtaaccatgttattaatgttaatgcccacggcattagcatttcatctcactactagaggtggggaaccacatatgatagtaagtaaacaggaaagaggaaaatcattactctttaaaacatcagcaggagtaaatatgtgcacattaattgcaatggatctcggagaactctgtgaggatacaatgacatataaatgtccacgaataacagaagctgaaccagacgacgtagattgttggtgtaatgcaacagacacatgggtaacatatggaacttgttctcaaacaggtgaacatagaagagataaaagatcagtagcactagcaccacacgtaggtctaggattagaaacaaggacagaaacatggatgtcttctgaaggggcttggaaacaaatacaaagagttgaaacgtgggcattaagacaccctggattcacagtaatcgcattatttttagcacacgccataggaacctctatcacccaaaaaggaataattttcatattactaatgctagtaaccccatcaatggctatgcgatgcgtaggaatcggtagtagagattttgttgaaggactaagcggagcgacatgggtagatgtcgtactagaacatggatcatgtgttacaacaatggcaaaagataaaccaacactagatatagaattattaaaaacagaagtgacaaacccagctgtactaagaaaactatgcatagaggccaaaataagtaatacaacgacagacagtagatgtccaacacaaggcgaagcaacccttgtagaagaacaagatgcaaacttcgtatgcagaagaacatttgtagacagaggttggggaaatggatgtggactctttggaaaaggatcattaatcacatgcgcaaaatttaaatgtgtaacaaaattagaaggaaaaatagtacaatatgaaaacttaaaatattcggtaatcgttaccgtacacactggagatcaacatcaagtagggaatgaatcaacagaacatggcactacagcaacaataacaccacaagcaccaacaacagaaattcaattaacagattacggagcactaactttagactgctcacctagaacgggtttagattttaacgaaatggttttattaactatgaaagaaaaatcatggttagttcacaaacaatggtttctagatctaccattaccatggaccagcggagcatcaacatcacaggaaacatggaacagacaagatcttttagtaaccttcaaaactgcacacgcaaagaaacaagaagtagtcgtactaggctctcaagaaggtgcaatgcatacggcattaacaggcgctacagaaatacagacgtctgggacaacaacaatattcgcaggacacctaaaatgcagattaaaaatggataaactgactttaaaaggaatgagttatgtaatgtgtacagggtcatttaaactagagaaagaagtcgcagaaacacaacacggaacagtgctagtgcaaataaaatatgaaggaacagatgcaccttgtaaaataccctttagcacacaagatgaaaaaggtgtaacccaaaatggaagattaataacagctaatccaatagttactgataaagaaaaaccagttaacatagaagcagaaccaccatttggggaatcatacatagtaatcggagcaggggaaaaagcattaaaactaagctggtttaagaaaggaagctcgataggtaaaatgtttgaagcaacagcaagaggagcaagaagaatggcaattttgggagacacagcatgggactttggcagtattggaggagtattcacttcagtaggaaaattagtccaccaaatatttggaactgcatacggagttctttttagcggagtatcatggaccatgaaaataggaataggagtacttctaacatggttaggacttaatagcaggagtacaagtttaagtatgacatgtatagcagttggtctagttaccctgtacttaggtgtaatggtacaagca

SEQ ID NO: 2192 - RNA, 2325 nt, synthetic construct
  misc_feature 1..2325: note = derived and/or modified CDS sequence (opt6) from DENV-1 CYD23__C-prME
  source 1..2325: mol_type = other RNA
atgaataatcaaaggaagaaaaccgcgaggccaagtttcaatatgcttaaaagagcaagaaatagagtgagtacagtctcacaattagctaaacgatttagcaaaggtttattatccggacaaggaccaatgaaattagttatggccttcatagcctttctaaggttcttagccataccacctacagcgggaatactagcaagatggggaagtttcaagaaaaatggtgcaataaaagttttaagaggatttaagaaagaaatatccaatatgctaaatattatgaatagacgaagaaaaagtgtgactatgttactaatgttaatgccaacagctcttgctttccatcttacaacaagagggggagaaccacacatgatagtatccaaacaagaaagaggaaaatcactgctctttaaaacaagtgcaggagtaaatatgtgtacattaatagcaatggacttaggggaactatgcgaagatacaatgacatacaaatgcccaagaatcacagaagcagaacctgacgatgtagactgctggtgtaacgcaacagatacctgggtaacctacggtacatgcagtcaaacgggagagcatcgaagagataaaagaagtgttgcattagcaccccacgtgggtttagggttagaaacaagaacagaaacatggatgagcagcgaaggtgcctggaaacaaatacaaagagtagaaacttgggcattaaggcatcccggctttacagtcatagcactattcttagcacatgctataggaactagcataacacaaaaaggaataatattcatattactcatgttagttacaccgtccatggctatgagatgcgtaggaataggaagcagagactttgttgaaggtctaagtggagcaacgtgggttgatgttgtattggaacatgggagctgtgtcacaacaatggctaaagataaacctacattagatatagaattactaaaaacagaggtcacaaatcctgcagtgcttaggaaattatgtatagaagcaaaaataagcaatacaacaaccgattcaagatgccctacccagggagaagccactctagtagaagaacaagacgcaaattttgtatgtagaagaactttcgtagacaggggttggggcaacggatgcggcttatttggaaaagggtctttaataacgtgtgcaaaatttaaatgtgtcacaaaattagaagggaaaatagttcagtatgaaaatttaaaatacagcgtcatagtaacagtacacactggtgatcaacatcaagtagggaatgagagtacagaacacggaacaacagcaacaataacgccacaagctccaacaaccgaaattcagctaacagattatggggcattaactcttgactgttcacctcgaactggcttagattttaacgaaatggttctattaacaatgaaagaaaaatcgtggctagtacataaacaatggttccttgacttaccattaccatggacaagtggtgcatctacctcacaagaaacatggaataggcaagatttattagtaacatttaaaacagcacatgcaaagaaacaagaagttgttgttttaggctcacaagaaggcgcaatgcatacagcattaactggagcaacagaaatacaaacatcaggaaccacaactatatttgcaggacacctcaaatgtagattgaaaatggataaattaacattaaaaggaatgtcatacgtgatgtgcacaggatcatttaaactcgaaaaagaagtcgcagaaacacaacacgggacagttttagtacaaataaaatacgaaggaacagatgcgccttgtaaaataccattctcaacacaagatgaaaaaggagtcactcaaaatggaagattaatcacggcaaacccaatagtaacagataaagaaaaacccgtgaatatagaggctgaaccaccatttggtgaaagctatatagtgataggagccggtgagaaagcactaaaattaagctggtttaagaaaggaagtagtataggaaaaatgtttgaagcgacagcacgaggagcaaggagaatggccatattaggagatacagcatgggattttggcagtattgggggagtatttacaagtgtaggtaaattagtacatcaaatttttggaacagcatacggagtactattctcgggagtttcgtggacaatgaaaataggaataggagtactcttaacatggttaggactaaattcaagatctacatcattaagcatgacttgtatagcggtaggattagttaccctttacctcggagtcatggtacaagca

SEQ ID NO: 2193 - RNA, 45 nt, synthetic construct
  misc_feature 1..45: note = derived and/or modified CDS sequence (opt6) from DENV-1 CYD23__SSc
  source 1..45: mol_type = other RNA
atgtcagtaacaatgttattaatgttaatgccaaccgcactcgca

SEQ ID NO: 2194 - RNA, 57 nt, synthetic construct
  misc_feature 1..57: note = derived and/or modified CDS sequence (opt6) from DENV-1 CYD23__SSopt
  source 1..57: mol_type = other RNA
atgaaaagaaaaaaatcagtaacaatgctactaatgctaatgccaacagcactagca

SEQ ID NO: 2195 - RNA, 57 nt, synthetic construct
  misc_feature 1..57: note = derived and/or modified CDS sequence (opt6) from DENV-1 CYD23__SSm
  source 1..57: mol_type = other RNA
atgacacaaaaaggaataatattcatactactaatgctagtaacaccatcaatggca

SEQ ID NO: 2196 - RNA, 1488 nt, synthetic construct
  misc_feature 1..1488: note = derived and/or modified CDS sequence (opt6) from DENV-1 CYD23__E
  source 1..1488: mol_type = other RNA
atgagatgcgtcgggataggttcacgggatttcgtagaaggattatcaggagcaacatgggtagacgtagtattagagcatggttcatgtgtaactacaatggctaaagataaaccaaccttagatatagaactattaaaaacagaagtaacaaacccagcagtattaagaaaattatgcattgaagcaaaaataagtaacacaacaacagatagtagatgtcccactcaaggagaggcaacactagtagaagaacaagatgcaaatttcgtatgccgacgcacttttgtagatagaggatggggaaatggatgcggattattcggaaaaggatcactaataacatgtgcaaagtttaaatgcgtaacaaaactagaaggaaaaatagtacaatacgaaaatctaaaatattccgtaatagtaacagttcatacaggcgaccaacatcaagtaggaaatgaatcaacagaacatgggacaacagcaacaataaccccgcaagctccaacgacagaaatacaattaacagattacggcgcactaactctagactgtagtccaagaacaggattagattttaacgaaatggtattactaacaatgaaagaaaaatcatggttagtccacaaacaatggtttctagatctcccattaccatggacatccggagccagcacttcacaagaaacctggaatagacaagacctactagtaacatttaaaacagcacatgcaaaaaaacaagaggtagtagtactgggatcacaagaaggagcgatgcatacagcgttaacaggagcaacagaaattcaaacatcaggaacaacaacaatattcgcaggacatttaaaatgcagattaaaaatggataaattaacgttaaaaggaatgtcatacgttatgtgtacaggaagttttaaacttgaaaaagaagttgcagaaacacaacacggaacggtacttgttcaaataaaatatgaaggcaccgatgcaccatgcaaaataccattcagtacacaagatgaaaaaggagtaacacaaaatggaagattaataacggcaaatcccatagtcacagacaaagaaaaaccagtaaacatagaagcagaaccaccgtttggtgaaagttatatcgtaataggtgcaggagaaaaagcattaaaattatcatggtttaaaaaaggatccagcataggtaaaatgttcgaagctacagcaagaggagcaagaagaatggcgatactaggagataccgcatgggattttggatcaataggaggagttttcacctcagtaggaaaattagtacatcagatattcggaacagcatacggtgttttattctccggagtcagttggacaatgaaaattggaataggagtactattaacatggttaggtctaaatagtagaagtacatcactaagtatgacatgtatagcagtcggattagtaacactatatctaggagtgatggtacaagcataa

SEQ ID NO: 2197 - RNA, 1182 nt, synthetic construct
  misc_feature 1..1182: note = derived and/or modified CDS sequence (opt6) from DENV-1 CYD23__EdelTM-variant (aa1-394)
  source 1..1182: mol_type = other RNA
atgagatgcgtaggaatcgggtcaagagactttgtagaaggattatcaggagcaacatgggtagacgtagtactcgaacacggctcatgcgtaacaacaatggcaaaagacaaaccaacactagacatagaattattaaaaacagaagtcacaaacccagcagtattaagaaaactatgcatagaagcaaaaatatcaaatacaaccacagactcaagatgcccaacacagggagaagcaacactcgtagaagaacaagatgccaattttgtatgcaggagaacatttgtagatagaggatggggcaacggatgcggattattcggaaaaggatcattaattacatgtgcaaaattcaaatgcgttacaaaactagaaggtaaaatcgtacaatatgaaaacctaaaatattcagtaatagtaactgtccatacaggagatcaacaccaagtaggtaatgaatcaaccgaacatggaaccacagcaacaataacaccacaagcaccaacaaccgaaatacaactaaccgactacggagcattaacattagactgctcaccaagaaccggattagacttcaacgaaatggtactactaacaatgaaagaaaaatcatggctagtacacaaacaatggtttttagacctaccactaccatggacatcaggtgcaagtacatcacaagaaacatggaatcgacaagacttactagtaacattcaaaacagcacacgcaaaaaaacaagaagtcgtagtactaggatcacaagaaggagcaatgcataccgcattaacaggagccaccgaaatacaaacaagcggaacaacaacaattttcgcaggacacctaaaatgcaggttaaaaatggacaaattaacactaaaaggaatgtcatacgtaatgtgcacaggatcattcaaactagaaaaagaagtagcagaaacacaacatggaacagtactagtacaaataaaatacgaaggaacagatgcaccatgcaaaataccattcagtacacaagacgaaaaaggagtaacacaaaatggcaggttaataacagcaaaccctatagtaacagacaaagaaaaaccagtaaacatagaagcagaaccaccattcggagaaagttatatagtaatcggagccggtgaaaaagctctaaaattatcctggttcaaaaaa

SEQ ID NO: 2198 - RNA, 1275 nt, synthetic construct
  misc_feature 1..1275: note = derived and/or modified CDS sequence (opt6) from DENV-1 CYD23__EdelTM-variant (aa1-424)
  source 1..1275: mol_type = other RNA
atgaggtgtgttggaataggcagcagagatttcgtagaaggcttaagcggtgcaacatgggtagacgtggtactagaacacggttcatgcgtaacgacaatggcaaaagataaaccaacactggacatagaattactaaaaactgaagtaacaaatccagcagtattaagaaaattatgcatagaagcaaaaatcagcaacacaacaacagatagtagatgcccaactcaaggagaagccacactcgtagaagaacaagatgcaaatttcgtctgtaggagaacatttgtagatagaggatggggaaatggatgtggactattcggaaaaggcagcttaataacatgcgcaaaatttaaatgcgtaacaaaattggaaggaaaaatagtacaatacgaaaacttaaaatattcagtaatagtaacagttcacacgggagatcaacatcaagtaggaaatgaatcaacagaacatggaacaacagcaacgataacgccacaagcaccaacaacagaaatacaattgaccgattacggagcattaacattagactgtagcccacgaacaggattagactttaacgaaatggtactattaacaatgaaagagaaaagctggcttgtacataaacaatggtttttagatctaccactaccatggacaagtggagcatcaacttcacaagaaacatggaacagacaagacttattagtaactttcaaaactgcacatgcgaagaaacaagaagtagtagtactaggatcacaagaaggagcaatgcatacagcactcacaggagctacagaaatacaaacatcaggtacaacaacgatctttgcgggacacctaaaatgcagactaaaaatggacaaactaacactaaaaggtatgagctatgtaatgtgcacgggttcattcaaactagaaaaagaagtcgcagaaacacaacatggaacagtcttagtacaaataaaatacgaaggtacagacgcaccatgcaaaataccatttagtacacaagacgaaaaaggagtaacacaaaatggaagactaataacagccaatccaatagtcactgacaaagaaaaaccagtaaacatagaagcggaaccaccctttggcgaaagctatatagttataggagcaggggaaaaagcacttaaattatcatggtttaagaaaggaagctcaataggaaaaatgtttgaagccacagccagaggagcaagaagaatggcaatcctaggagatacagcatgggatttcggatcttaa

SEQ ID NO: 2199 - RNA, 1266 nt, synthetic construct
  misc_feature 1..1266: note = derived and/or modified CDS sequence (opt6) from DENV-1 CYD23__EdelTM-variant (aa1-421)
  source 1..1266: mol_type = other RNA
atgcgatgtgtaggaataggatcaagagacttcgtagaaggactaagtggagccacatgggtggacgtagtactagaacatggaagttgtgtaacaacaatggcaaaagataaaccaacattggacatagaattattaaaaacagaagtaacaaacccagcagtactaagaaaactatgcatagaagcaaaaataagtaatactacaaccgattcaaggtgtccgacacagggagaagcaacactggtagaagaacaagatgctaattttgtatgtagaagaacatttgtagacagaggatggggcaacggatgcggattatttggaaaaggaagtctaatcacatgtgcaaaatttaaatgtgtaacaaaattagaaggaaaaatagtacaatatgaaaatttaaaatatagtgtgatagtaacagtacacacgggcgatcaacatcaagtaggaaatgaaagtacagaacatggaacaacagcaacaataacgccacaagcaccaacaacagaaatacaactaacagattatggagcactaacattagactgtagtccacgaacaggactagactttaacgaaatggtacttttgacaatgaaagagaaaagttggttagttcacaagcaatggtttttagatttaccattaccatggacaagcggagcgtcaacatcacaagaaacatggaacagacaagatctattagttacattcaaaacagcacatgcaaagaaacaagaagtagtagtactagggagtcaagaaggagcaatgcataccgctctaacaggagcaacagaaatacaaacatcgggaacaacaacaatatttgcaggacacctgaaatgccgactcaaaatggacaaattaacactaaaaggaatgagttatgtaatgtgtacaggatcattcaaactagaaaaagaagtagcagaaacacaacacggaacagtcctagtacaaataaaatatgaaggaacggacgcaccctgtaaaataccattcagtacacaagatgaaaaaggtgtaacacaaaacggaagattgataacagcaaatcctatagttacagacaaagaaaaaccagtaaatatagaagcagaaccaccattcggagaaagttatattgtaatcggagccggagaaaaagcattaaaactaagctggttcaagaaaggtagtagtataggaaaaatgtttgaagctactgcaagaggagctagaagaatggcaatattaggagatacagcttgggattaa

SEQ ID NO: 2200 - RNA, 2031 nt, synthetic construct
  misc_feature 1..2031: note = derived and/or modified CDS sequence (opt6) from DENV-1 CYD23__SSc-prME
  source 1..2031: mol_type = other RNA
atgtcagtaacaatgctattgatgctcatgcctactgctttagcatttcatcttacaacgcgaggaggagaaccgcacatgatagtatcaaaacaagaaagaggcaaatcattgctattcaaaacaagcgcaggcgtaaacatgtgtacattaatagctatggacttaggggagttatgcgaagatacaatgacatacaaatgtccaagaataacagaagcagaaccggacgacgtagactgttggtgcaacgcaacagatacatgggtaacatatggtacctgttctcaaacaggcgaacatagaagagataaaagaagcgtagcactagccccacacgttggtctaggattagaaactaggacagaaacatggatgtcctcagaaggagcatggaaacaaatacagagagtagaaacatgggcattaagacacccaggatttaccgtaatcgcattgtttttggcacatgcaataggaacatcaataacacaaaaaggaataatatttatactattaatgttagtaacacccagtatggcaatgagatgtgtaggcattggtagtagagattttgtagaaggtctatcaggagcaacttgggtagatgtggtattagaacatggcagttgtgtaactacaatggctaaagataaaccaacattagatatcgaattattaaaaactgaagtaactaatcctgcagtactaaggaaattatgcatagaagcaaaaataagtaacactacaacagatagtagatgcccgactcaaggggaagcaactctagtagaagaacaagatgccaattttgtttgtaggagaacattcgtagatagaggatggggtaatggctgtggtttatttggaaaaggttcattaataacttgcgcaaaatttaaatgcgtaacgaaactagaaggaaaaatagtgcaatatgaaaacctaaaatattcagtaatagttacagtacatactggtgatcaacatcaagtaggaaatgaatcaaccgagcatggaacaactgcaacgataactccccaagcaccaacaacagaaatccaattaaccgactatggagccttaactttagattgtagcccacgaacaggactagattttaatgagatggtattactaactatgaaagagaaaagttggctagttcataaacaatggtttttagatttaccactaccttggacaagtggtgcatccacaagtcaagaaacttggaatagacaagatctattagtgaccttcaaaacagcccacgccaagaaacaagaagtagtagtcttaggtagtcaagaaggagctatgcatacagcattaacaggtgccactgaaatacaaacatcaggtactactacaattttcgcaggacatttaaaatgtagactaaaaatggacaaactaacactaaaaggtatgagttatgtaatgtgcacaggatcatttaaattagagaaagaagtagcagaaacacaacatggaacagtattagttcaaataaaatacgaaggaacagatgcaccatgtaaaataccatttagcacgcaagatgaaaaaggagtaacccagaatggaagactaataacggctaacccaatcgtaacagacaaagaaaaacccgtgaatatagaagcagaaccaccatttggagaaagttacatagtgattggagccggagaaaaagcgttaaaattaagttggttcaagaaaggatcaagtataggaaaaatgtttgaagctacggcaagaggagcaagacgaatggcaatattaggagatacagcctgggattttggaagtataggaggtgtatttaccagcgtaggaaaattagtacatcaaatcttcggaactgcatatggagtactcttcagtggagtctcttggaccatgaaaataggtattggagtgttattaacatggctagggttaaacagtagatcaacttcactatcaatgacatgcatagctgtgggtctagtaactttatacttaggtgtaatggtacaagcataa

SEQ ID NO: 2201 - RNA, 2031 nt, synthetic construct
  misc_feature 1..2031: note = derived and/or modified CDS sequence (opt6) from DENV-1 CYD23__SSc-prME(F108S)
  source 1..2031: mol_type = other RNA
atgagtgtcacaatgctattaatgctaatgccaacggcactggcatttcatttaacaacaaggggaggagagccacatatgatcgtttctaaacaagaaagaggaaaatcactgttatttaaaacatcagccggtgttaacatgtgcacactaatagcaatggacttaggagaactatgtgaggacacaatgacttacaaatgtccaagaataacagaagcagagccagatgatgtagattgttggtgtaacgctacggatacatgggtaacttatggaacttgttcacaaacaggtgaacacagacgagataaaagaagtgtagcacttgcacctcatgtcggactaggtttagaaacaagaacagaaacatggatgtcatctgaaggagcatggaaacaaattcaacgagtagaaacatgggcattaaggcaccctggatttacagtcatagcattattcctagctcatgcaataggaacaagcataacacaaaaaggaataatattcatattattaatgctagtaacaccatcaatggcaatgagatgtgtaggtataggaagtagagattttgttgaaggactaagcggagccacatgggtagacgtggtactagaacatggatcatgtgtaacaactatggccaaagataaaccaacactagatatagaattactaaaaacagaagtaaccaatccagcggtacttagaaaactgtgtatagaagcaaaaatatctaatacaacaacagactcaagatgcccaacacaaggagaagctacgctagtggaagaacaagatgctaatttcgtgtgtagaagaacattcgtagacagaggatggggaaacggctgtggtctgagcggaaaaggatctttaataacttgcgcaaaatttaaatgtgtcacaaaattagaaggaaaaatagtccagtatgaaaatctaaaatattcagtaatagttacagtgcacacaggtgaccaacatcaagtaggaaatgaatcaaccgagcatggaacaacagccacaataacaccacaagcccccacaacagaaatacaactaactgactacggagcattaacactggattgttcaccacgaacaggattagatttcaacgaaatggtactactaactatgaaggaaaaatcttggctagtacataaacaatggtttctagatcttccacttccatggacatccggcgctagtacatcacaagaaacatggaatagacaagacctattagtcacatttaaaacagcacatgcgaagaaacaagaagtagtagtactaggttcgcaagagggagcaatgcacacagcactcacgggagcaacagaaatacaaacatcaggaacaacaacaatatttgcgggacatttaaaatgtagattgaaaatggataaattaaccctaaaaggtatgagttatgttatgtgtacaggaagttttaaattagagaaagaagtcgcagaaacacaacatggtaccgttttggttcaaataaaatatgaaggaaccgatgctccttgtaaaattccattcagtacgcaagatgaaaaaggagtaacacaaaacggcagattaataacagccaacccaatagtaactgataaagaaaaacccgtaaatatagaagcagaaccaccatttggtgaatcatacatagtaatcggagcgggggaaaaagcactaaaattaagttggtttaagaaaggcagttcgatagggaaaatgttcgaagcaactgcaagaggagcacgaagaatggcaatacttggagatactgcgtgggactttggaagtataggaggtgtatttaccagtgtaggcaaattagtacaccaaatatttgggacagcgtatggagtattattttctggagtatcttggacaatgaaaatcggtataggagttttactaacttggttagggctaaactcaagaagtacaagtttatcaatgacttgcatagcagtaggacttgtaacactttacttaggagtcatggtacaagcataa

SEQ ID NO: 2202 - RNA, 2031 nt, synthetic construct
  misc_feature 1..2031: note = derived and/or modified CDS sequence (opt6) from DENV-1 CYD23__SSc-prMEdelstem_TM-JEV
  source 1..2031: mol_type = other RNA
atgagtgtaacaatgttattaatgctcatgcccacagctttagcatttcatctaacaaccaggggtggagaaccccatatgatagtatccaaacaagaaagaggaaaaagtctcttatttaaaacaagtgccggcgtgaacatgtgtacactaatagcaatggatttaggagaactatgtgaagataccatgacatacaaatgcccacgtataacagaagcagaaccagacgatgtcgactgttggtgcaatgcaacagatacatgggtaacatatggcacatgttcgcaaactggtgaacacagaagagataaaagaagtgtagccttagcaccacatgtcggtctgggattagagacacgaactgaaacttggatgagttcagaaggagcatggaaacaaatacaaagagtcgaaacttgggcattaagacatccaggattcaccgttatagctttattcttagcacatgcaataggaacatcaataacacaaaagggtataatttttatattattaatgttggtaacaccatcaatggcaatgagatgtgtgggaataggttcacgagattttgttgaaggcttatcaggagccacatgggtagatgttgtgttagaacatggaagttgtgtaaccacgatggccaaagacaaaccaacgctagatatagaattactaaaaactgaagtaacaaatccagcagtactcagaaaactctgtatcgaagcaaaaataagtaacactactacagacagccgatgtccaacacaaggtgaagccacattagtagaagaacaagatgcaaattttgtatgtagaagaacattcgtggatagaggatggggaaatggctgtggattatttggaaaaggatctttaataacatgtgccaaatttaaatgcgtaacaaaattagaaggaaaaatcgtccaatatgaaaatctcaaatattcagtaatagttaccgtacatacaggagatcaacaccaagtcggcaatgaatcaacagagcacggaaccacagcaacaattactccacaagcacctacaacagaaatacaactaaccgactatggagcattgacattagattgtagtccaagaacaggactagactttaatgaaatggtactattaactatgaaagagaaaagttggctagtccataaacaatggtttctagatctaccactaccatggacaagtggagcaagtacttcacaagaaacctggaatagacaggatttattagtgaccttcaaaacagcacatgcaaagaaacaagaagtagtagttctaggttcacaagaaggagcaatgcacacggctttaacaggagcaactgaaatacaaacaagtggaacaacaacaatttttgccggacatctaaaatgcagattaaaaatggataaactaacactaaaaggaatgagttacgtaatgtgtacaggctcctttaaactagaaaaagaagttgccgaaactcaacatggaacagttttagtacaaataaaatacgagggtactgatgccccatgcaaaataccattttcaacacaagatgaaaaaggagtaacacaaaacggcagactaataacagcgaatccaatagtaacggataaagaaaaacctgtaaatatagaagccgaacctcctttcggagaatcctacattgtaataggagcaggagaaaaagccctcaaattaagttggtttaaaaagggatccacattaggaaaggctttttctacaacattaaaaggtgcacaacgactagcagctctaggtgatacagcatgggatttcggatcaataggaggagtattcaactctataggacgagcagtccaccaagtatttggtggtgcattcagaacactttttggaggaatgtcatggataacacaaggactaatgggagctttactactttggatgggtgtcaacgcaagagacagaagcatagctttagcatttttggcaactggaggagtattagtattcctggctacaaatgtacatgcataa

SEQ ID NO: 2203 - RNA, 2379 nt, synthetic construct
  misc_feature 1..2379: note = derived and/or modified CDS sequence (opt6) from DENV-1 CYD23__C-P2A-SSc-prME
  source 1..2379: mol_type = other RNA
atgaataaccaaagaaaaaaaacggcaagaccaagttttaatatgctaaagcgagcaagaaatcgagtatcaacggtttctcaacttgcaaaaagattctcaaaaggcttactaagtggacagggacctatgaaattagttatggcatttattgcatttttaagattcttagctataccaccaacagcaggaatattagctagatggggatcttttaaaaaaaatggagcaataaaagtattaagaggatttaaaaaagagatatcaaatatgttaaacataatgaaccgtaggagaaaaaacttcgatttactcaaactagcaggggatgtagaatcaaatccaggcccctcggttaccatgttattaatgctgatgcccactgcactagcatttcatcttacaacaagaggaggagaaccacatatgatagtctcgaaacaagaaagaggaaaatctttacttttcaaaacaagtgccggtgtaaacatgtgtacattaattgccatggatctaggggaactgtgtgaagacacaatgacatataaatgccccagaataacagaagcagaacccgatgatgttgattgttggtgtaatgcgactgatacatgggtaacgtacggtacatgttcacaaactggcgaacatagacgagataaacgaagcgtagcgcttgcacctcacgttggtttgggccttgaaacccgcacagagacttggatgtctagtgaaggcgcgtggaaacaaatccaaagagtcgaaacatgggcactaagacatccaggattcacagtaatagctctatttctagcccatgcaatcggaacttcaatcacgcaaaaaggcataatctttatattactaatgctagtcacaccatcaatggcaatgaggtgtgtaggaataggatctagagattttgtcgaaggattatccggagctacatgggtagatgtagtgttagagcacggtagttgcgttactaccatggcaaaagataaacctactctagatattgaactactaaaaacagaagtaacaaacccagctgtattaagaaaattatgcatagaagcaaaaataagcaatacaacaacagatagtagatgtccaacacaaggtgaagctacactcgtcgaagaacaggacgcaaattttgtatgtagaagaacatttgtagatagaggatggggaaatggatgtggactatttggaaaaggttcactattgacatgtgctaaattcaaatgtgtcactaaattagaaggaaaaatagtacaatacgaaaatctaaaatattcagtaatagtaacagttcatacgggagaccaacaccaagtaggaaatgaatctacagaacatggaactacagcaacaataacaccccaagcaccaacaacggagattcaacttacagattatggagcgctaaccttagattgttccccccgaacaggattagattttaatgaaatggtcctattgaccatgaaagaaaaatcctggctggtacataaacaatggtttcttgacttaccattaccatggacatccggagcaagtacatcacaagaaacatggaacaggcaagacctattagtcacctttaaaacagcacacgcaaaaaaacaagaagtagtagttctaggatcacaagaaggagccatgcatacagcacttacaggagcaacagaaatacaaacaagtggtacaactaccatctttgcagggcatctaaaatgcagattaaaaatggacaaactaactctaaaaggaatgtcttacgtgatgtgtacgggttcttttaaattagagaaagaggtagccgaaacacaacacggaacagtacttgtacaaataaaatatgaaggaacagatgcgccatgtaaaataccattctcaacacaagacgaaaaaggggtcacacaaaatggcagattgattacagccaatccaatagttacagataaagaaaaacctgtaaatatcgaagcagaaccgccattcggagagtcctacattgttataggcgcaggagaaaaagcattaaaactatcatggtttaaaaaaggatcaagcataggtaaaatgttcgaagcgacagcacgaggagcaagaagaatggctatactaggagatacagcttgggattttggatcaataggaggcgtcttcacatcagtaggtaaactagtacatcaaatatttggtacagcatatggagtattattctcaggagtttcatggactatgaaaataggaataggcgtactattaacttggttaggattaaattccagaagtacatcattgtctatgacttgcattgctgtaggactagtaactttgtatctaggagtaatggtacaagcatag

SEQ ID NO: 2204 - RNA, 2043 nt, synthetic construct
  misc_feature 1..2043: note = derived and/or modified CDS sequence (opt6) from DENV-1 CYD23__SSopt-prME(F108S)
  source 1..2043: mol_type = other RNA
atgaaacgaaagaaatccgtcacaatgcttctgatgttaatgccaacagccctagcattccacttaaccacaagaggaggagaaccacatatgatagtaagcaaacaagaaaggggtaaaagtttattattcaaaacaagtgctggagtaaacatgtgcacactaatagcaatggatttgggggaattatgtgaagatacaatgacatacaaatgtccacgtataacagaagctgaacctgatgacgtagattgttggtgcaatgctacggatacatgggtaacatatggaacttgctcacaaacaggagaacatagaagagacaaaagaagcgtagcactagcaccgcatgttggactaggcttagaaacaagaaccgaaacatggatgagcagtgaaggtgcatggaaacaaatccaaagagtagaaacatgggcacttcgacacccaggtttcactgtaatagctttattcttagcacacgcaattggtacgtccattactcaaaaaggcataatattcatactattaatgcttgtcaccccatcaatggcaatgcgatgtgttgggataggcagccgagactttgtagaaggattaagtggggcaacgtgggtcgatgttgttttagaacacggatcatgtgtaaccaccatggcaaaagacaaacccacactagatatcgaattattaaaaacagaagtaactaatcctgcagtattaagaaaactttgtatagaagctaaaataagtaatacaactaccgattcaaggtgcccgacccaaggagaagcaaccttagttgaagaacaagatgcaaacttcgtatgtagacgaacatttgttgatagaggatggggcaacggatgtggactaagtggaaaaggatcactaatcacatgcgcaaaatttaaatgtgttacaaaactagaaggaaaaatagtccaatacgaaaatttaaaatacagtgtaatagttacagtacacactggagaccaacatcaagtaggcaacgaatcaaccgaacacggaacaaccgctacaattaccccacaagcaccaacaacagagattcaattgacagattacggagcacttacattagactgttcaccaagaacaggattagattttaatgaaatggtactattaacaatgaaagagaaaagttggttagtacataaacaatggtttttagatctacccttaccatggacaagtggagcctcaacttctcaagaaacttggaatagacaagatctattagtcacatttaaaacagcacatgccaagaaacaagaagtcgtagtattaggatcacaggaaggcgctatgcatacagcattaacaggagcaaccgaaatacaaacatcaggtacaactacaatctttgcaggacacttaaaatgcagattaaaaatggacaaactaacattaaaaggaatgtcatatgtgatgtgtactggaagttttaaactagaaaaagaagtagcagaaacgcaacacggaacagtcttagtacaaattaaatatgaaggaacagacgcaccatgtaaaatcccattcagtactcaggacgaaaaaggggttacacaaaatggaagactaataacagcaaatcccattgtaactgacaaagaaaaaccagtaaatattgaagctgaacccccatttggtgaatcatacatagtaataggcgcaggagaaaaagcactaaaattatcctggtttaagaaaggatcatcaataggaaaaatgtttgaagcaactgcaagaggagcaagaagaatggcaatactaggggacacagcatgggactttggatcaatcggaggcgtatttacatctgtaggtaaattagttcatcaaatttttggaactgcctatggcgtattattttcaggcgtatcatggaccatgaaaataggaatcggagttttactaacatggttaggattaaattcccgaagcacgtcacttagcatgacatgtatcgcagtgggcctagtcacattatatttaggagtgatggtacaagcataa

SEQ ID NO: 2205 - RNA, 2043 nt, synthetic construct
  misc_feature 1..2043: note = derived and/or modified CDS sequence (opt6) from DENV-1 CYD23__SSopt-prME(F96H)
  source 1..2043: mol_type = other RNA
atgaagaggaaaaaatcggtcacgatgttattaatgttaatgccaacagcacttgcttttcatctaactacacgcggcggtgagccccatatgatagtaagtaaacaagaaagaggtaaaagtctactatttaaaacatctgcaggagtgaacatgtgtacattaatagcaatggatttaggtgagctatgcgaagacaccatgacctacaaatgtccaagaattacagaagctgaaccagatgatgttgattgctggtgcaacgccacagacacatgggtaacatatggaacatgctcacaaacaggagaacatagacgagataaaagatcagtagcattagcaccacatgtaggactgggactcgaaacgagaacagaaacctggatgagcagtgaaggagcatggaaacaaatacaaagggtagagacatgggcactaagacacccaggatttacagtaatagcactattccttgctcacgcaataggaacatccataactcaaaaaggaataatatttatattattaatgttagtcactccgagtatggcaatgagatgcgtaggaataggaagtagagattttgtagaaggcttatcaggcgcaacatgggtagatgtagtattagaacatggatcttgtgtaaccacgatggcaaaagataaaccaactttagacatagaactacttaaaacagaagtaacaaacccagccgtactaagaaaactatgtatagaagcaaaaataagcaatacaactaccgactcaagatgcccaactcaaggagaagccacactcgtggaagaacaagacgcaaactttgtatgcagaagaacacatgtagataggggatggggaaacggatgtggactattcggaaaaggatccctaataacatgtgcaaaattcaaatgtgtcacaaaattagaaggaaaaatagtacaatacgaaaacttgaaatacagcgtaatagtaacagtacatacaggagatcaacatcaagtaggaaatgaatcaactgaacatggaacaacagccacaataacaccacaagcaccaacaacagaaatacaactaacagattatggagccttaacactagactgttcaccgagaacaggcttagactttaatgaaatggtcttactaacaatgaaagaaaaaagctggttggtacacaaacagtggttcctagacctacccctaccatggacctcaggagcctctacctcacaagaaacctggaaccgacaagatttactggtaacatttaaaaccgcacatgcaaaaaaacaagaagtcgtcgtattaggcagtcaagaaggagcaatgcatacagcactcaccggtgcaacagaaattcaaacatcaggtacaacaactatatttgcaggacatttaaaatgccgtttaaaaatggacaaattgaccctaaaaggaatgagttacgtcatgtgtacgggaagttttaaactagaaaaagaagtagccgagacccaacacggaacagttttagtacaaattaaatatgaaggaacagacgctccatgcaaaataccattcagcacccaagatgaaaaaggtgtaacacaaaatgggcgattaattacagcaaatcctatagttacggacaaagaaaaacctgtgaatatagaagctgaaccaccctttggggaatcctatatagtaataggagcaggtgaaaaagcactaaaattaagttggttcaagaaaggatcaagtataggcaaaatgtttgaagcaacagcaagaggagcaagacgaatggcgatactgggagatactgcatgggattttggaagtataggaggagtatttactagtgtagggaaattagtacaccaaatattcggaactgcatatggtgtattattttcaggggtatcctggactatgaaaatcggaataggcgttcttttaacatggctaggtctaaattcaagaagcacatccttgtcaatgacttgcattgcagtagggctagtaactctatacttaggagtaatggtgcaagcatag

SEQ ID NO: 2206 - RNA, 2043 nt, synthetic construct
  misc_feature 1..2043: note = derived and/or modified CDS sequence (opt6) from DENV-1 CYD23__SSopt-prME(S186F)
  source 1..2043: mol_type = other RNA
atgaaacgaaagaaatcggtaacaatgctattaatgctaatgccaacagcactagcctttcacctaacaacaagaggaggagaaccccatatgatagtatcaaaacaagaaagaggaaaatcattattatttaaaacaagtgccggagtgaatatgtgcacactaatagcgatggacctaggagaactatgtgaagataccatgacatataaatgcccaagaataactgaagcagaaccggatgatgtagattgctggtgcaatgcaacagacacatgggtaacatatggaacatgttcacagactggagaacataggagagataaacgatcagtagcattagcaccacacgtaggcctaggactagaaacaagaacagaaacatggatgtcatcagaaggggcatggaaacaaatacaacgcgtagaaacatgggcattacgacatccaggattcactgttatagctctatttctagctcatgcaataggaacatcaattacacaaaaaggtataatatttatattattgatgctagtaacacctagtatggctatgagatgtgttggtataggaagcagagacttcgttgaaggattatccggcgcaacatgggtagatgtagtattggaacatggcagctgcgtaacaactatggcaaaagacaaaccaactctagatatcgaattattaaaaaccgaagttacaaacccggccgtattacggaaattgtgtatagaagccaaaataagtaacacaacaactgattcaagatgtccaacccaaggagaggcaacattagttgaagaacaagacgcgaattttgtatgtagaagaacatttgttgacagaggatgggggaatggctgcggattatttggaaaaggatcattaataacatgcgctaaatttaaatgtgtaacaaaattagaaggaaaaatagtacaatacgaaaatctaaaatatagcgtaatagttacagtacataccggagatcaacatcaagttggaaacgaatcaacagagcatggaacaacggcaacaataacaccacaggcaccaacaacagaaatacaattaacagattatggcgctttaacattggattgttttccaaggacaggactagattttaatgagatggttttattaacaatgaaagagaaaagctggttagtacataaacaatggttcttagatttacctctcccatggacaagtggagcaagtacaagtcaagaaacgtggaacagacaagatcttttagtaacattcaaaacagcacatgctaagaaacaagaagtggtagtactaggctcgcaagagggagctatgcatacagcattaacaggagcaactgagatacaaacatcaggaacaactacaatctttgcaggacatttaaaatgtaggctaaaaatggataaactaacattgaaaggcatgtcctatgtaatgtgcacaggatctttcaaactagaaaaagaagtagcagaaactcaacatggaacagtattagtccaaataaaatatgaaggaacagacgcaccatgtaaaataccattttctactcaagatgaaaaaggcgtcacacaaaatggaaggctaataacagctaatccaatagtcacagataaagaaaaacctgtaaacatagaagctgaaccacctttcggtgaatcttacatagtaataggagcaggagaaaaagcgttaaaattaagctggtttaaaaagggttcgagtatcggaaaaatgttcgaggcaacagcaagaggagcgagaagaatggcaattcttggagatacagcttgggattttggaagcataggtggagtatttacatctgttggaaaattagtacaccaaatttttggaacagcatatggagtattgttttcgggagtttcatggactatgaaaataggaataggtgtcttattaacatggctaggacttaattcaagatcaacatccttatcgatgacatgcatagctgtagggctagtaacattatatctaggagtcatggtacaagcgtaa

SEQ ID NO: 2207 - RNA, 2043 nt, synthetic construct
  misc_feature 1..2043: note = derived and/or modified CDS sequence (opt6) from DENV-1 CYD23__SSopt-prME(R188L)
  source 1..2043: mol_type = other RNA
atgaaacgcaagaaaagcgtaacaatgttactaatgttaatgccaacagcactagcctttcatttaacgacaagaggaggagaaccgcatatgatagtcagtaaacaggaaagaggtaaaagcctattgttcaaaacaagtgcaggagtgaacatgtgtactctaatagctatggacttaggagaattatgtgaggatacaatgacctataaatgccctaggataacagaagcagaaccagacgatgtcgattgctggtgtaatgcaacagacacctgggtaacatatgggacatgcagccaaacaggagagcatagaagggacaaacgatcagtagcactagcgccacatgtaggattaggactggaaacacgcactgaaacatggatgagctcagaaggagcatggaaacaaatacaaagagtagaaacatgggcactacgacacccaggatttacagttatcgcactatttctagcacacgcgataggaacatcaataactcaaaaaggaataatttttattcttttgatgttagtcacaccatccatggcaatgagatgtgttggaataggatcaagagatttcgtagagggtctaagcggagcaacatgggtagatgtagttcttgaacacggttcttgtgtaacaacaatggcgaaagacaaacctacactagatattgaattacttaaaactgaagtaacaaacccagccgttctaagaaaattatgtatagaagcaaaaataagtaatacaactacagattcgagatgtccaacacaaggtgaagcgacactcgtagaagaacaggacgcaaacttcgtatgtagaagaacatttgtagatagaggttggggaaatggttgtggattatttggaaaaggaagtttaataacatgtgcgaaattcaaatgcgttacaaagttagaaggaaaaattgtacaatatgaaaatctaaaatattcagtaattgttacagtacacacaggagatcaacaccaggtaggtaatgaatcgactgaacacggaactacagctacaattacaccacaagcaccaacaacggaaatacaactaacagattatggtgcactaactctagattgtagtcctctaacgggtctagatttcaatgaaatggtactattaacaatgaaagaaaaatcatggctagtacacaaacaatggtttttagacctaccgttaccctggacaagtggagcaagtacctcacaagaaacgtggaatagacaagacctattagttacttttaaaactgcacatgccaagaaacaagaagttgtagtattgggaagtcaagaaggagcaatgcacacagctttaacaggtgcaacggaaatacagacaagtggcactacgacaatcttcgcagggcacttaaaatgtagactaaaaatggataaattaacactaaaagggatgagctatgtaatgtgcacaggtagcttcaaactagaaaaagaagtagcagaaacgcaacatggaacggtattggtacaaattaaatatgagggaacagatgcaccatgtaaaataccattctcaacacaagacgaaaaaggagttacacaaaatggacgattaataacagcgaatccaatagtcacagataaagaaaaaccagttaacatagaagctgaaccaccttttggagaatcatatatagtaatcggtgctggagaaaaagcattaaaattaagttggtttaagaaaggatcatcgataggaaaaatgtttgaagccacagcaaggggagcaaggaggatggccatactaggagatacagcatgggattttggatcaatcggaggagttttcacatcagtaggaaagctagtacatcaaatttttggaactgcatacggagtcttattttcgggagtaagttggacaatgaaaataggaataggcgtactcctaacatggttaggactaaattcacgaagcacatcattaagtatgacatgcatagcagtaggcctagtaacattgtatcttggagtgatggtacaagcataa

SEQ ID NO: 2208 - RNA, 2043 nt, synthetic construct
  misc_feature 1..2043: note = derived and/or modified CDS sequence (opt6) from DENV-1 CYD23__SSopt-pr(D104A)MEdelstem_TM,(F108S)-JEV
  source 1..2043: mol_type = other RNA
atgaaaagaaagaaaagcgtaacgatgttactaatgttaatgccaacagcattggcctttcacttaacaacgagaggtggagaaccacatatgatagtaagtaaacaagaacgaggaaaatcactactatttaaaacatcagcaggagtaaacatgtgtacgctaattgcaatggatttaggagaattatgtgaagatacaatgacatataaatgtcccagaataacggaagcagaacccgacgatgtagattgctggtgcaatgcaaccgatacatgggtaacatacggaacatgctcccaaacgggagaacacagacgagcaaaaagatccgtcgcactagctccacacgttggactaggacttgaaacaagaacagagacatggatgagtagtgaaggggcatggaaacaaatacagagagttgaaacatgggcactaagacatccaggatttacagtcatagctctcttcttagcgcatgctattggcacaagtataacgcaaaaaggaataatattcatattactaatgctagtaacaccgagtatggcaatgagatgtgtaggaataggtagtagggactttgtagaaggattaagtggagctacttgggttgatgtagtgttagaacatggttcgtgcgtaacaacaatggcaaaagataaaccaacactagatatagaattactcaaaactgaagtaacaaaccccgctgtactaaggaaattgtgtatagaagcaaaaataagtaataccacaacagattctaggtgtccaacacaaggagaagccacgttagtcgaagaacaagatgcaaacttcgtatgcagaaggacatttgtagacaggggatggggaaacggttgtggattaagtggaaaaggaagtctaataacatgcgcaaaatttaaatgtgttactaaattagaaggtaaaatagttcaatatgaaaacctaaaatactcagtaatagtcacagtacacacgggagatcaacatcaagtgggaaacgagtccacagaacacggtacaactgcaacaataacaccacaagctccaaccacagaaatccaattaaccgattacggagctttaacattagattgttcacctagaacaggactagattttaacgaaatggtattattaacgatgaaagagaaaagttggcttgtccataaacaatggttccttgacctaccactcccatggacatcaggtgcttcaacctcacaagaaacatggaataggcaagatttattagttacattcaaaacagcacatgcaaagaaacaagaagtagtagtattaggctcacaagaaggcgctatgcatactgcattaacaggagcgacagagattcaaacatcaggaactacaactatatttgcaggacatctaaaatgcagattaaaaatggataaactaacactcaaaggtatgtcatatgttatgtgcacaggatcttttaaattagaaaaagaagtagctgaaacacaacatggtacagtgttggtacaaataaaatatgagggaaccgatgcaccttgtaaaataccattttcaactcaagacgaaaaaggagtaactcaaaatggaagattaataacagctaatccaatagtaacggataaagaaaaaccagtcaatattgaagcggaacccccattcggagaaagttatatagtgatcggagctggagaaaaagcgctaaaattgagctggttcaagaaaggatcaacactaggaaaagcgttcagtacaactttaaaaggagcacaaaggctagcagctctaggggatactgcgtgggattttgggagcataggaggagtgtttaactcaataggtagagcagttcatcaagtatttggaggagctttccgcacactatttggaggtatgagttggataacacaaggtcttatgggtgctttactattatggatgggtgtaaatgcaagagacagaagtatagcattagcatttttggcaactggaggagttctagtatttttagcaacaaacgtacacgcataa

SEQ ID NO: 2209 - RNA, 2043 nt, synthetic construct
  misc_feature 1..2043: note = derived and/or modified CDS sequence (opt6) from DENV-1 CYD23__SSopt-prMEdelstem_TM,(H261N)-JEV
  source 1..2043: mol_type = other RNA
atgaaacgaaagaaatcagtaacaatgttattaatgctaatgcctactgcattagcatttcacttaacaacacgaggaggagaaccacacatgatagtaagtaaacaagaacgaggaaaaagtttattattcaaaacaagcgcaggagtaaatatgtgtacattgatagcaatggatctaggcgaattatgcgaagatacgatgacctacaaatgtccaagaataacagaagcagaacctgacgatgtagattgctggtgtaatgcaacagatacttgggtaacatatggaacatgtagccaaacaggtgaacatagacgagataaaagatcagtagcattagcgcctcacgtaggactaggtttagaaacgagaacagaaacttggatgagtagtgaaggcgcttggaaacaaatccaacgagtagaaacctgggcactacgtcatccaggctttacagtaatagctttatttttagcacacgcaattggaacctcaataacacaaaaaggaatcatatttattctactaatgctagtaacaccatcaatggcaatgagatgtgtgggtataggtagcagggactttgtagaaggcttatcaggagcaacatgggtagatgtcgtattagaacatggatcatgtgttacaacaatggcaaaagacaaaccaacattggatatagaactacttaaaactgaagtaacgaacccagctgtactgagaaaactatgtattgaggcaaaaattagtaacacaactacggacagtagatgtccaactcaaggagaagctaccctagtggaagaacaagatgcaaactttgtatgtagaagaacatttgtagatagaggttggggaaatggatgcggactattcggaaaaggatcattgataacatgcgctaaatttaaatgtgtaacaaaattggaaggaaaaattgtacaatatgaaaatttaaaatacagtgtgatagtaacagtccacacaggagaccaacaccaagtaggaaacgaatcaaccgaacatggaacaacagctacaattactccacaagctccaacaacagaaatacaattaacagactatggagctctaacactagattgctcaccacgaacggggctggactttaacgaaatggtactcttaacaatgaaagagaaaagttggctagtacataaacaatggtttttagatctaccgttaccttggacatcgggagcaagtacgtcacaagaaacatggaatagacaagatttattagtaacattcaaaacagcacacgcaaagaaacaagaagttgtagtattaggctcacaagaaggagcaatgaatactgcactaactggagcaacagaaatacaaacttcgggaactactacaatatttgctggtcacttaaaatgtcgattaaaaatggataaactaactctaaaaggcatgagctatgtaatgtgtacaggatcatttaaattagaaaaagaagtagcagaaacacaacatggtacagtgttagtacaaataaaatatgaaggaacagatgcaccatgcaaaataccatttagcacgcaagatgaaaaaggagtcacacaaaatggaagactaatcacagccaacccgattgtaaccgataaagaaaaaccagtaaatatagaagcagaaccaccgtttggagaatcatacattgttataggagctggggaaaaagcccttaaattaagttggtttaagaaaggatcaacattaggaaaagcatttagtacaactctaaaaggagcacaaagactagctgcgctaggagatactgcatgggattttggaagcataggaggagtgttcaatagtatcgggagagcagtacatcaagttttcggaggtgcatttagaacacttttcggtggaatgtcttggataactcaaggattaatgggagcgcttttactatggatgggagtcaatgcaagggaccggagtatagctttagcatttttagcaacaggtggagttctagtattcttagcaacaaatgtacatgcataa

SEQ ID NO: 2210 - RNA, 2043 nt, synthetic construct
  misc_feature 1..2043: note = derived and/or modified CDS sequence (opt6) from DENV-1 CYD23__SSopt-prMEdelstem_TM,(R188L,A267T)-JEV
  source 1..2043: mol_type = other RNA
atgaagagaaagaaaagtgtgacaatgttattaatgttaatgccaacagccctagcatttcatctaacaacaagaggaggtgaaccacatatgattgttagtaaacaagaaagaggaaaaagtctattatttaaaacgagcgccggagtaaatatgtgcactcttattgctatggatttgggcgaattatgcgaagatacgatgacttacaaatgcccaagaataacagaagcagaaccagatgacgttgattgctggtgcaacgcaaccgatacatgggtaacatatggaacttgctcgcaaacaggtgaacatagaagagataaaagatcagtagccctagcacctcacgtaggactaggactagaaactcgaaccgaaacatggatgagttcagaaggagcctggaaacaaatacagcgagtggaaacgtgggcactcagacacccaggctttacagtaattgcattatttttggcacatgctataggaacatcaataacacaaaaaggtattatatttatactgttaatgctagtaaccccatcaatggccatgaggtgcgtagggataggctctagagattttgtagaaggtttaagcggagcaacatgggtagatgtagtcttagaacacggaagttgtgtaacaacaatggcgaaagacaaacctacacttgatatagaacttctaaaaacagaagtaacaaacccggcagtgctacgaaaattatgtatagaagcaaaaataagtaatacaacaactgacagcagatgccctacacagggagaagcaacattagtagaagaacaagacgcgaactttgtatgtagaagaaccttcgtagatagaggatgggggaacggttgtggattattcggtaaagggtctttaataacatgcgctaaatttaagtgtgtaacaaaattggaaggaaaaatagtccaatacgaaaacctaaaatattctgtaatcgtcacagtccacaccggagatcaacaccaggtaggaaatgaatcaaccgaacatggaacaacagctaccataacgccacaagccccaacaacagaaatacaactaaccgattatggagcactaacgttagactgctctccactaactggcttagactttaatgaaatggtcctattgactatgaaagaaaagagttggttagtacacaaacaatggtttctagacttaccactcccatggacgagcggagcatcaactagccaagaaacatggaatagacaagatctattagtcacattcaaaacagctcacgctaagaaacaggaagttgtagtattaggatcccaagaaggtgctatgcacactgcactaacaggaacaacagaaattcaaacaagtggtacaacaacaatttttgcaggacatctaaaatgcagattgaaaatggacaaattaacattaaaaggaatgagctatgtaatgtgtacaggaagttttaaactagaaaaagaagtagcagaaactcaacacggaactgtattagtacaaataaaatatgaaggaacagatgctccatgtaagatacctttcagtacacaagatgaaaaaggcgtaacacagaacgggagactcataacagctaacccaatagtaacagacaaagaaaaaccggtaaacatagaagctgaaccaccatttggagaaagttatatagtcataggagctggagaaaaagctctaaaattatcatggttcaagaaaggtagcactttaggaaaagcatttagcacaacactaaaaggagcacaaaggctagcagcactaggagacactgcgtgggatttcggaagtataggaggagtatttaatagcatagggagagcagtgcatcaagtatttggaggtgcattcagaacattatttggaggaatgagctggatcacacagggattaatgggagcactattgttatggatgggtgtaaatgcaagagatagatcaattgcactagcattcctagcaactggaggtgtacttgtatttttagcaacaaacgttcatgcatag

SEQ ID NO: 2211 - RNA, 300 nt, synthetic construct
  misc_feature 1..300: note = derived and/or modified CDS sequence (opt6) from DENV-2 CYD2-T__C
  source 1..300: mol_type = other RNA
atgaacaaccaaagaaaaaaagcaaaaaacacaccattcaacatgctaaaaagagaaagaaacagagtaagcacagtacaacaactaacaaaaagattcagcctaggaatgctacaaggaagaggaccactaaaactattcatggcactagtagcattcctaagattcctaacaataccaccaacagcaggaatactaaaaagatggggaacaataaaaaaatcaaaagcaataaacgtattaagaggattcagaaaagaaataggaagaatgctaaacatactaaacagaagaagaaga

SEQ ID NO: 2212 - RNA, 342 nt, synthetic construct
  misc_feature 1..342: note = derived and/or modified CDS sequence (opt6) from DENV-2 CYD2-T__C-SSc
  source 1..342: mol_type = other RNA
atgaacaaccaaagaaaaaaagcaaaaaacacaccattcaacatgctaaaaagagaaagaaacagagtaagcacagtacaacaactaacaaaaagattcagcctaggaatgctacaaggaagaggaccactaaaactattcatggcactagtagcattcctaagattcctaacaataccaccaacagcaggaatactaaaaagatggggaacaataaaaaaatcaaaagcaataaacgtactaagaggattcagaaaagaaataggaagaatgttaaacatactaaacagaagaagaagatcagcaggaatgataataatgctaataccaacagtaatggca

SEQ ID NO: 2213 - RNA, 273 nt, synthetic construct
  misc_feature 1..273: note = derived and/or modified CDS sequence (opt6) from DENV-2 CYD2-T__pr
  source 1..273: mol_type = other RNA
tttcacttaacaacaagaaatggagaaccacatatgatagtatcaagacaagaaaaaggaaaaagcttactatttaaaacagaagatggagtaaacatgtgcacactaatggcaatggacttaggagaactatgtgaagatacaataacatataaatgtccattactaagacaaaatgaaccagaagatatagattgctggtgcaatagcacaagcacatgggtaacatatggaacatgcacaacaatgggagaacacagaagagaaaaaaga

SEQ ID NO: 2214 - RNA, 225 nt, synthetic construct
  misc_feature 1..225: note = derived and/or modified CDS sequence (opt6) from DENV-2 CYD2-T__M
  source 1..225: mol_type = other RNA
tcagtagcattagtaccacatgtaggaatgggactagaaacaagaacagaaacatggatgtcatcagaaggagcatggaaacacgtacaaagaatagaaacatggatactaagacatccaggattcacaatgatggcagcaatattagcatatacaataggaacaacacatttccaaagagcactaatattcatactattaacagcagtaacaccatcaatgaca

SEQ ID NO: 2215 - RNA, 498 nt, synthetic construct
  misc_feature 1..498: note = derived and/or modified CDS sequence (opt6) from DENV-2 CYD2-T__prM
  source 1..498: mol_type = other RNA
ttccacttaacaacaagaaacggagaaccacatatgatagtatcaagacaagaaaaaggaaaaagtctactattcaaaacagaagacggagtaaacatgtgcacactaatggcaatggacttaggagaattatgcgaagatacaataacatataaatgcccattactaagacaaaatgaaccagaagacatagactgctggtgcaacagcacaagcacatgggtaacatacggaacatgcacaacaatgggcgaacacagaagagaaaaaagaagcgtagcattagtaccacacgtaggaatgggattagaaacaagaacagaaacatggatgagctcagaaggagcatggaaacacgtacaaagaatagaaacatggatactaagacacccaggattcacaatgatggcagcaatactagcatacacaataggaacaacacactttcaaagagcactaatattcatattactaacagcagtaacaccaagcatgaca

SEQ ID NO: 2216 - RNA, 1485 nt, synthetic construct
  misc_feature 1..1485: note = derived and/or modified CDS sequence (opt6) from DENV-2 CYD2-T__E
  source 1..1485: mol_type = other RNA
atgagatgtataggaatgagtaatagagactttgtagaaggagtaagtggaggaagctgggtagatatagtattagaacacggatcatgcgttactaccatggcaaaaaacaaaccaacattagacttcgaattaataaaaacagaagccaaacaaccagcaacactaagaaaatactgcatagaagcaaaacttacaaatactacaacagaaagtcgatgccctacacagggagaaccaagtttaaacgaagaacaagataaacgattcgtatgcaaacactccatggttgacagaggatggggaaacggatgtggcctatttggtaaaggaggtatagtaacatgtgcaatgtttaggtgcaaaaaaaacatggaaggaaaagtagttcagccagaaaacctagaatatacaatagtaataacaccacacagtggagaagaacatgccgtaggcaatgatacaggaaaacatggaaaagaaataaaaataaccccccaaagctcaataacagaagcggaattaacaggatacggaactgtaacaatggaatgtagcccaagaactggattagatttcaacgagatggtactattacaaatggaaaataaagcatggctagtacatagacaatggtttcttgatctaccactaccatggttaccaggcgcagatacacaaggatcaaactggatacaaaaagaaactctagtaacattcaaaaacccacacgcaaaaaaacaagatgtcgtagtcctcggatcacaagaaggagcaatgcatactgcactaacaggagcaacagaaattcaaatgtcaagcggaaatctactattcacaggacacttaaaatgtagactaagaatggacaaactacaactaaaaggcatgtcatatagtatgtgcactggaaaattcaaagtagtaaaagaaatagcggaaacacaacatggaactatagtaataagagtacaatatgagggagatggaagtccatgcaaaataccctttgaaataatggatctagaaaaaagacacgtcctaggaagattaataacagtcaatccaatagttacagaaaaagacagtccagtaaatatagaagcagaaccaccattcggagacagctacattataataggagtagaacccggacaattaaaactaaattggtttaaaaaaggtagctcaattggacaaatgtttgaaacaacaatgagaggtgcaaaaaggatggcaatattaggagatactgcatgggatttcggaagcttaggaggagtattcacatcaataggaaaagctctacatcaagtgttcggagcaatctatggggctgcattcagcggagtatcatggacaatgaaaatattaataggtgtaataataacatggattggaatgaattcacgatcaactagcttgagcgtaaccttagtattagttgggatagttacattatatctaggagtaatggtacaagca

SEQ ID NO: 2217 - RNA, 1983 nt, synthetic construct
  misc_feature 1..1983: note = derived and/or modified CDS sequence (opt6) from DENV-2 CYD2-T__prME
  source 1..1983: mol_type = other RNA
tttcacctaacaacacgcaatggagaacctcatatgatagtctcacgacaagaaaaaggaaaaagtttgttatttaaaacagaagatggagttaatatgtgtacattaatggcaatggacctaggagaattatgtgaagacacaattacctataaatgtccactattaagacaaaatgaacctgaagacattgattgttggtgcaactcaacttcaacttgggtaacatacggaacttgtacaacaatgggcgaacataggcgtgagaaaagaagtgtagccctagtaccacacgttggaatgggacttgaaactcgaacggaaacatggatgagctcagaaggagcatggaaacacgtacaacgaatagaaacatggatattaagacatccaggtttcacaatgatggcagcaatacttgcatatacaatagggactacacattttcaaagagcactaatatttatattgttgacagcagtgacaccatcgatgacaatgagatgcataggcatgagtaatagagattttgtagaaggagtgagtggaggttcatgggtagatatagttttagaacatggaagttgcgttacaactatggctaaaaataaaccaacattggactttgaactaattaaaacagaagcaaaacaacccgcaacgctcaggaaatactgtatagaagcaaagctaacaaacacaacaacagaaagcagatgtccaacacaaggagaaccatccttaaatgaagaacaagataaaagatttgtttgcaaacactcaatggtggacagaggttggggtaacggatgtggactatttggaaaaggaggtattgtaacttgtgcaatgttcagatgtaagaaaaatatggaaggaaaagtagtccaaccagaaaacctagaatacacaatagtaataactccccattcaggagaagaacacgcagtaggcaacgatacgggaaaacatggaaaagaaataaaaataacacctcagagcagtataacagaagcagaacttaccggatatggtacagttacaatggaatgtagcccaaggacaggcttggactttaatgaaatggtattattacaaatggaaaacaaagcatggttagtacatcgacaatggtttctcgatttacccctaccatggctacccggagctgacacccaaggcagtaattggatacaaaaagaaactctagttaccttcaaaaatccgcatgcaaagaaacaggatgtagtagttttagggagccaagaaggtgctatgcacacagcgttaacaggagcgacagagatacaaatgtcaagtggtaatctgttatttacaggacatctaaaatgcaggttaagaatggacaaattgcaattaaaaggaatgagttactcaatgtgcacagggaaatttaaagtagtaaaagaaattgcagaaactcaacatggaacaatagtaataagagttcaatatgaaggagacggaagcccttgcaaaataccatttgaaataatggatttagagaaaagacatgtattaggaagattaattactgtaaatccgatagtaacagaaaaagattcaccagtaaatatagaagctgaaccgccttttggagatagttatataataataggagtagaaccaggacaattaaaattaaattggttcaagaaaggaagtagcataggacaaatgttcgaaaccacaatgagaggggcaaaaaggatggcaatactaggagatactgcgtgggattttggatcactaggaggagtattcacaagcataggaaaagcactacaccaagtattcggagctatatacggcgcagcatttagtggcgtatcctggacaatgaaaatcttaataggcgtaataataacatggataggaatgaacagtcgatcaaccagcttaagtgtaacattagtattagtaggaatagtaacactatacctaggagtaatggtacaagcc

SEQ ID NO: 2218 - RNA, 2025 nt, synthetic construct
  misc_feature 1..2025: note = derived and/or modified CDS sequence (opt6) from DENV-2 CYD2-T__SSc-prME
  source 1..2025: mol_type = other RNA
agcgcaggaatgataataatgttaatacctactgtcatggcatttcatcttacaacaagaaacggggaaccacatatgatagttagccgtcaagaaaaaggtaaaagtttattatttaaaactgaagatggagtaaatatgtgtaccttaatggcaatggatcttggcgaattatgcgaagatacaattacatataaatgtccattattacgacaaaatgaaccagaagacatagattgttggtgcaattcaacaagcacttgggtgacgtacggtacatgcaccacaatgggagaacatagaagagaaaaaagatcagtggcactggttccacacgtaggaatgggattagagacaagaacagaaacatggatgtcaagtgaaggagcatggaaacatgtacaaagaatagaaacatggatactccgacatccaggttttacaatgatggcagctattttagcatatacaataggaactacacatttccaaagagcattaatttttatactattaacagcagtaactccctcaatgacaatgagatgtataggaatgtcgaatagagatttcgtagaaggagtttcaggtggaagctgggtagacatagttttagaacatggatcatgcgtaacgacaatggcaaaaaacaaaccaacacttgatttcgaattaataaaaactgaagcaaaacaacccgcaacactgaggaaatattgtatcgaagcaaaattaacaaacactactactgaaagtagatgtccaacacaaggcgaaccaagcctaaatgaagaacaagataaaagattcgtctgcaaacatagcatggttgacagaggatggggaaatggatgcggtttattcggaaaaggaggtatagtaacttgtgctatgtttaggtgcaaaaaaaatatggagggaaaagtagtacaacctgaaaatctagaatataccattgtgattacgccacatagtggtgaagaacatgctgtaggtaatgataccggaaaacacggaaaagaaataaaaatcacacctcaaagtagtataacagaagcagaactaacaggatatggaacagtaacgatggaatgctccccaagaactggcctagattttaatgaaatggtactactacaaatggaaaataaggcatggcttgtccatagacaatggtttcttgacctgccacttccatggttaccaggagctgatacccaaggatcaaactggatacaaaaagaaacactagtaacatttaaaaatcctcacgcaaaaaaacaagatgtagtagtattaggatcacaagaaggagcaatgcatacagcactaacaggagcaacagaaatacaaatgtcaagtggaaatttactttttacgggacatttaaaatgtagacttagaatggacaaattacaattaaaaggtatgagttattcgatgtgtacaggaaaattcaaagtagtaaaagaaatagcagaaacacaacacggtacaatagtaatacgagtacaatatgaaggcgatggatcaccctgcaaaataccattcgaaataatggacttagaaaaaagacacgttctgggaagattaattacagtaaatcccatagtaacagaaaaagacagtccagtgaatattgaagcagaaccaccatttggagatagttatataataataggagttgaaccaggtcaattaaaactaaactggtttaaaaaaggatcaagtataggccaaatgttcgaaaccactatgcgaggtgcaaaacgaatggcgatactaggagatacagcatgggattttggatcactaggaggagtttttactagtataggtaaggcacttcatcaagtattcggagcaatatatggagcagcattttcaggagtatcatggacaatgaaaattttaatcggagtaataataacatggataggtatgaattcaagatccacttcgttaagtgtcacgttagttttagtaggaatagtaaccctctatttaggagtaatggtacaagcc

SEQ ID NO: 2219 - RNA, 2325 nt, synthetic construct
  misc_feature 1..2325: note = derived and/or modified CDS sequence (opt6) from DENV-2 CYD2-T__C-prME
  source 1..2325: mol_type = other RNA
atgaacaaccagaggaaaaaggctaaaaacactccatttaacatgctaaaaagagaaagaaatagagtatccactgtacagcagttaaccaagagatttagtctaggaatgttacaaggtagaggaccattaaaactttttatggccctagtagcatttttaagattcctaacaatcccacccaccgcagggatccttaaaagatggggcaccataaagaaatcaaaagcaattaatgtcctaagaggtttcagaaaagaaataggaagaatgctaaatattttaaatagaagaagaagatcagcaggaatgataataatgttaatacccacagtaatggcattccacctaactactagaaatggggaaccacatatgatcgtatctaggcaagaaaaaggaaaatccctattatttaaaacagaagacggagtaaatatgtgtacattaatggccatggatttaggagaattatgtgaagatactattacatataaatgtccactgttaagacaaaacgaacctgaagacattgattgttggtgcaattcaacaagtacttgggtaacttatggaacatgcacaacgatgggagaacatagacgtgagaaaagaagcgtagctctagtcccacatgtaggaatgggtttagaaacacgaacagaaacatggatgtcgtcagaaggagcttggaaacatgtacaacgaatagaaacatggatattaagacatccaggatttacaatgatggcagccatattagcatatacaataggaacaacacactttcaacgtgcacttatatttatactactaactgcagtaaccccaagcatgacaatgagatgcataggcatgagtaatagagatttcgtcgaaggagtttcaggtggaagttgggtagacatcgtactagaacatggatcctgtgtaactactatggctaaaaataaaccaacacttgattttgaattaataaaaacagaagccaagcaaccagctactttaaggaaatactgcatagaagcaaaattaacaaatacaactaccgaatctcgatgtccaacacaaggggagccgtcattaaacgaagaacaagataaacgatttgtatgtaaacattctatggtagacagaggatggggaaacggatgtggactattcggaaagggaggtatagtcacttgtgcaatgtttagatgtaagaaaaatatggaaggtaaagttgtacaaccagaaaacctcgaatatacaatagtaataacacctcattcaggagaagaacatgcagtaggaaacgatactggaaaacatggcaaagaaatcaaaataacgcctcaaagcagcattactgaagcagaacttactggatacggaactgtaacaatggaatgcagtccaagaaccggactcgattttaatgaaatggtactactgcaaatggaaaataaagcgtggttggtacatcgccaatggttcttagatttacccttgccctggctaccaggggcagacacacaaggaagtaactggatacaaaaagaaactttagtaacatttaaaaaccctcacgcaaagaaacaagatgtagtagtattaggatctcaagagggagcaatgcataccgctctaacaggcgcaactgaaatacaaatgagtagtggaaatttattatttactggacatctgaaatgtagacttagaatggacaaactacaactcaaaggaatgagttatagcatgtgtacaggaaaatttaaagtagtcaaagaaattgcagaaacacaacatggaacaatagtaataagagttcaatatgaaggcgatggatcaccatgtaaaataccctttgaaattatggacttagagaaaagacacgtattaggacgattaataacagtaaatccaattgtgacagaaaaagattcaccagtcaacatagaagcagaacctccatttggcgacagctacattataattggagttgaaccaggacaattaaaattaaactggtttaagaaaggttcttcaattggacaaatgttcgaaacaacaatgcgaggagcaaaaagaatggcaatattaggagatacagcatgggatttcggatcattaggtggagtattcacgtcaataggcaaagcgctacatcaagttttcggggcaatatacggagcagcattttccggagtttcatggacaatgaaaatactaattggagtaataataacctggataggaatgaatagcagatcgactagcctatccgttaccctagtcttagtaggaatagtaacactatatctaggcgtaatggtacaagca

SEQ ID NO: 2220 - RNA, 45 nt, synthetic construct
  misc_feature 1..45: note = derived and/or modified CDS sequence (opt6) from DENV-2 CYD2-T__SSc
  source 1..45: mol_type = other RNA
atgagcgcaggaatgataataatgttaataccgacagtaatggca

SEQ ID NO: 2221 - RNA, 57 nt, synthetic construct
  misc_feature 1..57: note = derived and/or modified CDS sequence (opt6) from DENV-2 CYD2-T__SSopt
  source 1..57: mol_type = other RNA
atgaaaagaaaaaaaagcgcaggaatgataataatgttaataccgacagtaatggca

SEQ ID NO: 2222 - RNA, 57 nt, synthetic construct
  misc_feature 1..57: note = derived and/or modified CDS sequence (opt6) from DENV-2 CYD2-T__SSm
  source 1..57: mol_type = other RNA
atgtttcaacgtgcacttatatttatacttctaactgcagtcacaccttcaatgaca

SEQ ID NO: 2223 - RNA, 1488 nt, synthetic construct
  misc_feature 1..1488: note = derived and/or modified CDS sequence (opt6) from DENV-2 CYD2-T__E
  source 1..1488: mol_type = other RNA
atgagatgcataggaatgagcaacagagacttcgtagaaggagtaagtggcggaagttgggtagatatagtattagaacatggtagttgtgtaacaacaatggccaaaaataaaccaacattagattttgaattaataaaaacagaggcaaaacaaccagcaacactaagaaaatattgcatagaagcaaaattaacaaatacaacaacagaaagcagatgcccaacacaaggagaaccaagtttaaatgaagaacaagacaaaaggtttgtatgtaaacatagcatggtagatagaggatggggcaatggatgcggactttttggaaaaggaggaatagtaacatgcgcaatgtttagatgtaagaaaaatatggaaggtaaagtagtacaaccagaaaatctagaatacacaatagttataactccgcatagtggagaagaacacgccgtgggaaatgatacaggaaaacacggaaaagaaataaaaataacaccacaaagctcaattacggaagctgagttaacaggatatggaactgtaacaatggaatgtagtccaagaacaggattagatttcaatgaaatggtactactacaaatggaaaataaagcatggctagtacatcgacaatggtttctagacttacctttaccatggctgccaggagcagatacacaaggttcaaattggatacaaaaagaaacattagtaacatttaaaaatccacacgcaaagaaacaagatgtagtagttttaggtagtcaagaaggcgcaatgcatacagcactgacaggagcgactgaaatacaaatgtcaagcggaaatttactatttacaggacatttaaaatgtagattgagaatggataaattacaactaaaaggaatgagctattcaatgtgtacaggaaaatttaaagtagtaaaagagatagccgaaactcaacacggaacaatagttatcagagtacaatatgaaggggatggaagcccatgtaaaataccatttgaaataatggatttagagaaaagacatgtattaggaaggttaataacagtaaatccaattgtaacggaaaaagattcaccagttaatatagaagcagaacctccatttggagatagctacataataattggagtagaacccggacaactaaagttaaattggttcaagaaaggaagttcaataggtcaaatgtttgaaacaactatgagaggagcaaaaagaatggctatattaggtgatacagcatgggattttggatctttaggaggagtatttacatcaataggaaaagcactacaccaagtatttggagctatatatggagccgcatttagtggagtaagctggacaatgaaaatactaattggagtgataataacatggattggtatgaatagtagatcaacatcactaagtgtaactctagtcctagtaggaatagtaacattatatctaggagtaatggttcaagcgtaa

SEQ ID NO: 2224 - RNA, 1182 nt, synthetic construct
  misc_feature 1..1182: note = derived and/or modified CDS sequence (opt6) from DENV-2 CYD2-T__EdelTM-variant (aa1-394)
  source 1..1182: mol_type = other RNA
atgcgatgcataggaatgagcaacagagactttgtagaaggcgtaagtggaggcagttgggttgacatagtcttagaacatggatcatgcgtcacaacaatggcaaaaaataaaccaaccctagattttgaattaataaaaacagaagccaaacaaccagcaacacttaggaaatactgcattgaagcgaaattaacaaatacaactactgaaagcagatgcccaacccaaggagaaccaagcctaaatgaagaacaagacaaaagattcgtatgcaaacactctatggtagacagaggctggggaaatggatgtggattattcggaaaaggaggaatagttacatgcgcaatgtttagatgtaaaaaaaacatggaaggaaaagttgtacaacctgaaaacttagaatatacaatagtaatcacaccacatagcggagaagaacatgcagtaggaaacgatacaggtaaacacggaaaagaaataaaaatcacaccacaaagcagtataacagaagcagaattaacaggatacggaacagttacaatggaatgtagcccaagaacaggactagactttaatgaaatggtactactacaaatggaaaataaagcgtggttagtacatagacaatggtttctagatcttcctctaccatggttaccaggagcagatacacaaggatcaaactggatacaaaaagaaacattagtaaccttcaaaaacccacacgctaaaaaacaagatgtagtagtattaggatcacaagaaggcgcaatgcatacagcattaactggcgcaacagaaatacaaatgtcttcaggaaacctactattcacaggacacctaaaatgcagacttcgaatggacaaactacaattaaaaggaatgagttactcaatgtgcaccggaaaattcaaagtagtaaaagaaatagcagaaacacaacatggaacaatagttataagagtccaatacgaaggagatggttcaccatgtaaaatcccatttgaaataatggacctagaaaaacgtcacgttttaggaagattaataacagtaaacccaatagtaacagaaaaagacagcccagtaaacatagaagcagaacctccatttggagatagctatataataataggggtagaaccaggtcaactaaaattaaattggtttaaaaaa

SEQ ID NO: 2225 - RNA, 1272 nt, synthetic construct
  misc_feature 1..1272: note = derived and/or modified CDS sequence (opt6) from DENV-2 CYD2-T__EdelTM-variant (aa1-424)
  source 1..1272: mol_type = other RNA
atgagatgtataggaatgtcaaacagagactttgtagaaggagtaagcggaggaagttgggtagacatagtattagagcatggcagttgcgtaacaacaatggcaaaaaataaaccaacccttgactttgaactaataaaaaccgaagccaaacaaccagcaaccctaagaaaatattgtatagaagcaaaattaactaacacaacaacggaaagcagatgcccaacacaaggagaaccatcactaaatgaagaacaagataaaagattcgtttgcaaacattcaatggtagacagaggatggggaaatggatgtggacttttcggaaaaggaggcatagtaacatgcgcaatgtttagatgcaaaaaaaacatggaaggaaaagtagtccaaccagaaaacttagaatacacaatagtaataaccccacatagcggcgaagaacatgccgtaggaaatgacacaggaaaacatggaaaagaaataaaaataacaccccaaagtagtatcacagaagcagaactaaccggatatggaacagtaacaatggaatgcagtccaagaacaggattagacttcaacgaaatggtactcctacaaatggaaaataaagcatggctagtacacagacaatggtttcttgacttaccactcccatggctaccaggagcagatacacaaggaagtaactggatacaaaaagaaacactagtaacatttaaaaatccgcacgcaaaaaaacaagatgtagtagtcttaggatcacaagaaggagcaatgcatacagcattaacaggagctacagaaattcaaatgagcagcggaaacctattatttacaggacacctaaaatgtagactaagaatggataaattacaattaaaaggaatgagctattcaatgtgtaccggaaaatttaaagtagtgaaagaaatagcagaaacacaacatggaacaatagtaatacgtgttcaatacgaaggagacggatcaccatgcaaaataccatttgaaataatggatctagaaaaaagacacgtattaggaagactaataacagtcaatccaatagtaacagaaaaagactcaccagtaaatatagaagcagaaccaccattcggagatagctatataataataggagtagaaccaggacaattaaaattaaattggttcaaaaaaggtagcagcataggacaaatgttcgaaaccacaatgagaggagcaaaaagaatggcaattttaggagacacagcatgggatttcggatca

SEQ ID NO: 2226 - RNA, 1263 nt, synthetic construct
  misc_feature 1..1263: note = derived and/or modified CDS sequence (opt6) from DENV-2 CYD2-T__EdelTM-variant (aa1-421)
  source 1..1263: mol_type = other RNA
atgagatgtataggtatgtcgaacagagactttgtcgaaggagtgagtggaggaagttgggtagacatagtattagaacatggctcatgcgtaacaacaatggcaaaaaataaaccaacactggactttgaattaataaaaacagaagcaaaacaaccagcaacattaaggaaatactgcatagaagcaaaattaacaaatacaacaacagaaagtagatgcccaacacaaggagaaccatcattaaatgaagaacaagataaaagatttgtatgtaaacacagtatggtagatagaggatggggaaatggatgcggactatttggaaaagggggaatagtaacctgtgcaatgtttagatgtaaaaaaaacatggaaggaaaagtggtacaaccagaaaacctagaatacacaatagtaataacaccacactcaggagaagaacatgcagttggaaatgacacaggaaaacatggaaaagaaataaaaatcacaccccaaagctcaataacagaagcagaactaaccgggtacggaacagtaacaatggaatgtagcccaagaacaggactagactttaatgaaatggtactactacaaatggaaaataaagcatggttggtacacagacaatggtttttagatctaccattgccatggttaccaggggcagatacacaaggatcaaattggatacaaaaagaaacattagtaacgtttaaaaatccacacgctaaaaaacaagatgtagtagtattaggaagtcaagaaggggctatgcatacagcattaacgggagcaacagaaattcaaatgtcatcaggtaacttactatttacaggacacttaaaatgtagactacgaatggataaactacaacttaaaggcatgagctacagcatgtgtacgggaaaatttaaagtagtaaaagagattgccgaaactcaacatggaactatagtaatcagagtacaatatgaaggagacggaagtccttgcaaaatcccatttgaaataatggatttagaaaaaagacacgtgttaggaagattaataacagtaaatccaatagtgacagaaaaagacagcccagtaaacatagaagctgaaccaccctttggagatagctacataataataggagtagaaccaggacaattaaaattaaactggttcaaaaaaggatcatcgataggacaaatgtttgaaacaacaatgagaggagcgaaaagaatggcaatattaggagacaccgcttgggat

SEQ ID NO: 2227 - RNA, 2031 nt, synthetic construct
  misc_feature 1..2031: note = derived and/or modified CDS sequence (opt6) from DENV-2 CYD2-T__SSc-prME
  source 1..2031: mol_type = other RNA
atgtcagctggtatgataataatgttaataccaacagtaatggcattccatttaactacgaggaatggagaacctcacatgatagtatcaagacaggaaaaaggtaaaagtctattatttaaaacagaagatggagttaatatgtgtacattaatggcaatggacttaggcgaattatgtgaagatactatcacttataaatgtccgctactcagacaaaatgaacccgaagacatagattgttggtgcaatagtacaagtacatgggtgacatacggaacatgtacaacaatgggagaacatagaagagagaaaagatccgtagcattagtaccacatgtaggaatgggactagaaacacgaacagaaacatggatgtcatcagaaggagcgtggaaacatgtgcaaagaattgaaacatggattctcagacatccaggatttacaatgatggcagctatactagcatatacaataggaaccactcacttccaacgtgctctaatatttatattattgactgcagtaacaccaagtatgacaatgagatgcataggaatgagtaatagggactttgtagaaggagtatcaggaggatcatgggtagatatagtattagaacacggcagttgtgttacaactatggccaaaaataaaccaacactagattttgaactaataaaaacagaagctaaacaaccagccactttaagaaaatattgtattgaagcaaaactaactaatactactacagaatcaaggtgtccaacccaaggagaaccatctttaaacgaagaacaagacaaacgtttcgtttgtaaacatagtatggtagatagaggttggggaaatggatgcggtttatttggaaaaggcggaatagtaacatgtgcaatgtttcgatgtaagaaaaatatggaaggaaaagttgtacaaccagaaaatctagaatatacaatagttataacacctcactcaggagaagaacacgcagtaggtaacgatactggaaaacatgggaaagagattaaaataacaccacaaagttcaataactgaggccgaactaacaggatatggtacagtaacaatggaatgcagtccaagaacaggtttagactttaacgaaatggtactattacaaatggaaaataaagcatggctagtacatagacaatggtttttagatttacctctaccatggctaccgggtgctgatacacaaggctcaaattggattcaaaaagaaaccttagtaacttttaaaaacccccacgctaagaaacaagatgtagttgtattaggatcacaagaaggagcaatgcatacagcactaacaggagccacagaaatacaaatgtcttctggaaacttattatttacaggacatctaaaatgtagattaagaatggataaacttcaattaaaaggtatgtcttattcaatgtgtaccggaaaatttaaagtagtcaaagaaatagcagaaacacaacatggaacaatagtaataagagtccaatatgaaggagatgggagcccctgtaaaataccatttgaaataatggatttagagaaaagacatgtattaggaagattaataacagtaaatccaatagtaacagaaaaagatagcccagtaaatatagaagcagaaccaccatttggagattcttatataataataggagtagaaccaggacagctgaaattaaattggtttaagaaaggaagttcaataggccaaatgtttgaaactacaatgcgtggagccaaaaggatggcaatactgggagacacagcatgggatttcggtagtctaggaggagtctttacgagcataggaaaagcacttcatcaagtatttggagcaatctacggagcagcatttagcggagtatcatggacaatgaaaatactaataggagtaataattacttggataggaatgaactcacgatcaacatcactcagtgttactctagtattagtaggtatagtaacattatatcttggggttatggtacaagcatag

SEQ ID NO: 2228 - RNA, 2031 nt, synthetic construct
  misc_feature 1..2031: note = derived and/or modified CDS sequence (opt6) from DENV-2 CYD2-T__SSc-prME(F108S)
  source 1..2031: mol_type = other RNA
atgtcagcaggaatgatcataatgttaatacctacagtaatggcttttcaccttacaaccagaaacggtgaaccacacatgatcgtaagcagacaggagaaaggaaaaagtctattattcaaaacagaagatggagtaaatatgtgcacgttaatggcaatggatctaggggaactatgcgaagatacaataacctataagtgtcctctactaagacaaaatgaaccagaagacatagattgttggtgtaacagtacatcaacctgggtaacgtatggtacatgcacaacaatgggggaacatagaagggagaaaagaagcgtagctttagttcctcatgtaggcatgggattagaaactagaacggaaacatggatgagtagtgaaggagcatggaaacatgttcaaagaatagaaacatggatcttaagacacccgggatttacaatgatggcagctatactagcatacacaataggaacaacacatttccaaagagcattaatatttatactactaacagcagttacaccatcaatgactatgagatgtataggtatgagtaatcgagatttcgtagaaggggttagcggtggatcatgggtagacattgtgttagaacatggaagttgtgttacaactatggctaaaaataaacctacattagactttgaattaataaaaacagaagcaaagcagccagctactttaagaaaatactgtatagaagcaaaactaacaaacacaactacagaaagtcggtgtccaactcaaggagaaccttcacttaatgaagaacaagacaaaagatttgtatgcaaacatagtatggttgatagaggatggggaaatggttgtggacttagtggcaaaggtggcatagtaacatgtgcaatgttcagatgtaagaaaaatatggaagggaaagtagttcaaccagaaaacttagaatatacaatagtaataacaccacactccggagaagaacatgctgtcgggaatgacactggaaaacatggaaaggaaattaaaatcactccgcaaagcagcataacagaagcagagttaacaggctatggaacagtaacaatggaatgtagtcccagaacaggattagatttcaatgaaatggtgttattacaaatggaaaacaaagcatggttagtacatagacaatggttccttgatctacctttaccatggctcccaggagcagacactcaaggatccaattggatacaaaaagaaactttggtaacatttaagaacccacatgccaaaaagcaagatgtagttgtattaggaagtcaagaaggagcaatgcatactgcactaaccggagctacagaaatacaaatgagttcgggaaacttactctttactggacacctaaaatgtagacttagaatggataaattgcaattaaaaggaatgtcatactcaatgtgcacgggaaaatttaaagttgtaaaagaaatagcagaaacacaacatggaaccatagtaataagagtacaatatgaaggagatggaagcccatgtaaaataccatttgaaatcatggatctcgagaaaagacacgtgttaggtagattgattacagtaaacccaatagtcacagaaaaagattcccccgtaaacatagaagctgaaccaccctttggggattcatatataataataggagtagaaccaggacaactaaaactaaactggtttaagaaaggttcaagcataggacaaatgtttgaaacaacaatgagaggagcaaaaagaatggcaatattaggtgacacagcatgggattttggttcactaggaggagtcttcacatcaattggaaaagccctacatcaggtctttggagcaatatatggggcagcattttcaggagtatcatggacgatgaaaatattaataggagtaataataacatggataggaatgaatagtagatcaacatcattaagtgttactctagtattagtcggcatagtaacattgtatttaggagtaatggtacaggcatag

SEQ ID NO: 2229 - RNA, 2031 nt, synthetic construct
  misc_feature 1..2031: note = derived and/or modified CDS sequence (opt6) from DENV-2 CYD2-T__SSc-prMEdelstem_TM-JEV
  source 1..2031: mol_type = other RNA
atgagtgctggaatgataataatgttaatacccactgtaatggcatttcatttaactacaagaaatggagaaccacacatgattgtaagtagacaagaaaaaggtaaatctttactatttaaaacggaagacggagtaaatatgtgtacactaatggcaatggacctaggagaactatgtgaagacacaataacgtacaaatgtccattactaagacaaaatgaaccagaagacatagattgttggtgcaatagtacgagtacttgggtaacttatggtacatgcacgactatgggagaacacaggagggagaaaagaagcgtagctctagtaccccacgtaggaatgggactagaaaccagaactgaaacatggatgagcagcgaaggagcgtggaaacatgtccagcgaatagaaacttggatattaagacacccaggatttacaatgatggcagcaatattagcatataccataggaactactcattttcaaagagcactaatcttcatattactaacagctgtaactccgagtatgacaatgaggtgcataggaatgtcaaatagagactttgttgaaggagttagtggaggatcctgggtagatatagtattagaacatggctcatgcgttacaacaatggctaaaaacaaaccaacactagattttgaattaataaaaacagaagcaaaacaaccagcaacattaagaaaatactgtattgaagccaaattaactaacacaactacagaaagtagatgtccaacacaaggagaaccatcactgaacgaagaacaagataaaagattcgtatgtaaacatagtatggtagatcgaggatggggaaatggatgcggactatttgggaaaggcggtatagtaacatgtgcaatgtttcgatgtaagaaaaatatggaaggaaaggtagtacaacctgaaaatctagaatacacaatagtaataacaccccatagtggagaagaacacgccgtaggaaacgataccggaaaacatggaaaagaaataaaaattacaccacaaagtagtataacagaagcagaattaaccggctatggaactgtaactatggaatgtagtccaagaacaggattagatttcaatgaaatggtactactacaaatggaaaacaaagcatggttagtacaccgacaatggttcctagatttaccacttccatggctaccgggagctgatacacaaggatccaattggattcaaaaagaaacattagtaacatttaaaaacccacacgcaaagaaacaagatgtcgtagttttaggaagtcaagaaggagcaatgcataccgcactgacaggagcaacagaaatacaaatgagttcaggaaacctattatttacaggccacttaaaatgtaggctacgaatggacaaattgcaactcaaaggaatgagttacagcatgtgtactggcaaatttaaagtagtcaaagagatcgcagaaacacaacacggaactatagtaatacgagtacaatatgaaggcgatggtagcccatgtaaaataccatttgaaataatggatttagagaaaagacatgtattaggaagactaataacagtaaatcctattgtaacagaaaaagattcaccggtcaacatagaagccgaaccaccctttggtgattcttacataataataggcgtagaacccggtcaactcaaattaaattggttcaagaaaggaagcacactaggtaaagcattctctacaacattaaaaggagcccaaaggttagcagcattaggagatactgcttgggacttcgggtcaatcggaggcgtattcaactccataggtagagcagtacatcaagttttcggaggagcgttccgaaccttgtttggaggaatgagctggataacacaaggcttaatgggagcattactattatggatgggagtaaacgctagagataggtccattgctcttgcctttctagcaacaggaggagttctagtatttttagctacaaatgtacatgcataa

SEQ ID NO: 2230 - RNA, 1332 nt, synthetic construct
  misc_feature 1..1332: note = derived and/or modified CDS sequence (opt6) from DENV-2 CYD2-T__SSm-EdelTM
  source 1..1332: mol_type = other RNA
atgtttcaaagagcattgatctttatactgctaacagcagtaacaccaagcatgacaatgagatgcataggtatgtcaaacagagattttgtagaaggagtaagcggaggctcatgggtagatatagtactagaacatggttcatgcgttacaacaatggcaaaaaacaaaccaacattagattttgaactaataaaaacagaagccaaacaaccagcaactctaagaaaatattgtatagaagcaaaattaacaaatactacaaccgaatccagatgtccaacccaaggagaaccaagtctaaacgaagaacaagataaaagatttgtatgtaaacactcaatggtagacagaggatggggaaatggctgtggactattcggcaaaggaggcatagtaacatgcgcaatgttcaggtgcaaaaaaaatatggaaggtaaggtagtacaaccagaaaacctagaatatacaattgtaattacaccacattcaggagaagaacatgcagtaggtaatgacacaggtaaacacggaaaagaaataaagataacaccacaatcaagtataacagaagctgaattaacaggatacggaacagtaacaatggaatgttcaccgaggacaggactagactttaacgaaatggtactcttacaaatggaaaataaagcatggctagtacatagacaatggttcttagatttaccattaccttggttaccaggagcagatacacaaggcagcaattggatacaaaaagaaacactagtaacatttaaaaacccacacgctaaaaaacaagacgtagtagtacttggatcacaagaaggcgcaatgcatacagcattgacaggagctacagaaatacaaatgagttcaggaaacttactattcacaggacacttaaaatgtagactaagaatggacaaattacaactaaaaggaatgagttatagcatgtgtactggaaaattcaaagtagttaaagaaatagccgaaacacaacacggtacaatagtaataagagtacaatacgaaggagatggcagtccatgtaaaatcccttttgaaataatggacttagaaaaacgacacgtactaggaagattaataacagtaaatccaatagtaactgaaaaagattcaccagtaaacatagaagcagaaccaccctttggagattcatacataataattggagtagaaccaggacaacttaaactaaactggtttaaaaaaggatcaagtataggacaaatgtttgaaacaacaatgagaggcgcaaaaagaatggcaatcctaggtgatactgcatgggattttgggtcataa

SEQ ID NO: 2231 - RNA, 2379 nt, synthetic construct
  misc_feature 1..2379: note = derived and/or modified CDS sequence (opt6) from DENV-2 CYD2-T__C-P2A-SSc-prME
  source 1..2379: mol_type = other RNA
atgaacaaccaaagaaagaaagccaaaaatacgcctttcaatatgctaaaaagagaaagaaatagagtatctacagtacaacaactcacaaaaagatttagtcttggaatgctacaaggcagaggacctttaaaattattcatggctctagttgcatttctaagatttcttacaataccacccaccgcaggaatactaaaacgatggggaactataaagaaaagcaaagctataaacgtattaagagggtttagaaaagagatcggtagaatgttaaatatattaaatagaagaagaagaaatttcgatcttttaaaacttgctggagacgttgagagtaacccaggtccaagtgcgggaatgataattatgctgatacccacagtaatggctttccatttaactacaagaaatggtgaacctcatatgatcgtcagtagacaagaaaaaggaaaaagtctactattcaaaacagaagatggtgtcaacatgtgtacattgatggcaatggacttaggcgaattgtgtgaagatactattacttacaaatgtccgctactaagacaaaatgaaccagaagatattgattgctggtgtaactcaacatcaacatgggtaacttacggaacctgtacaacaatgggggaacataggagagagaaaaggagcgttgcgctcgttccacatgttggtatgggattagaaacaagaacagaaacatggatgagctcagaaggtgcatggaaacacgttcaacgtatagaaacatggattctaagacaccctggattcactatgatggctgcaatactagcatatacaataggaactacacactttcaaagggcactaatattcatattactaacagctgtaacaccaagtatgacaatgagatgtataggaatgagtaacagagattttgtagaaggagtatccggcggttcatgggtagatatagtactagaacacggatcatgtgtaacgacaatggcgaaaaacaaaccgacattagatttcgaattaataaaaacggaagcaaaacaaccagcaaccttaaggaagtactgtatagaagctaaactaacaaacacgacaaccgaatctagatgtcctacacagggtgaaccctctttgaatgaagaacaagataaaagatttgtttgtaaacattctatggtagatagaggttggggtaacggatgtggattatttggaaaaggaggaatagtaacatgcgcaatgttcagatgtaagaaaaatatggaaggtaaagtagtacagcctgagaaccttgaatacaccatagttattacaccacattcaggcgaagaacacgcagtgggaaatgacactggaaaacatggtaaagaaattaaaataacaccgcaaagtagcataacagaagctgaactaacaggatatgggacagtcacgatggagtgtagcccacgaacaggcctagattttaacgaaatggtacttctacaaatggaaaataaggcttggttagtacatagacagtggtttcttgatctacctttaccatggctacctggtgcagatacacaaggctcgaactggatacaaaaagaaactctagtcacatttaaaaatccacatgcaaagaaacaagacgtagtggtacttggatcacaagaaggagctatgcatacagcactaacaggggctactgaaatacaaatgagtagcggtaacttgttattcactgggcatttaaaatgtagattaagaatggacaaactacaattaaaaggaatgagttactcaatgtgtacaggaaaattcaaagtagttaaagaaatagcagaaacacaacacggtacgatagtaattagggtacaatatgaaggggacggatctccctgtaaaataccatttgaaataatggatttagagaaaagacacgttctaggaaggttaataactgtaaacccaatagtaacagaaaaagattcacctgtaaacatagaagcagaaccaccattcggagactcatatataataataggagtagaacccggacaattaaaattgaactggtttaagaaaggatcaagcataggacaaatgtttgaaactacaatgagaggtgcaaaaagaatggcaatattgggagataccgcatgggactttggtagcttaggaggagtgtttaccagcataggaaaagcattacaccaagtatttggggctatttacggagcagcattttcgggagttagctggactatgaaaatattaataggtgtgatcataacatggataggtatgaatagtagatctacaagtttatctgtaactttagtgctagtaggtatagtaacattatatctaggtgtaatggtacaagcataa

SEQ ID NO: 2232 - RNA, 2043 nt, synthetic construct
  misc_feature 1..2043: note = derived and/or modified CDS sequence (opt6) from DENV-2 CYD2-T__SSopt-prME(F108S)
  source 1..2043: mol_type = other RNA
atgaaacgaaagaaaagcgcaggaatgattataatgctaatacccacagttatggcatttcatctaacaacaaggaatggagaaccacacatgatagtatcaagacaagaaaaaggtaaaagtttactttttaaaacagaagatggagttaatatgtgtacactgatggccatggatctaggtgaactatgtgaagatacaataacatataaatgtcctttgctacgacaaaatgaaccagaagatatagattgctggtgtaatagcacatcgacatgggtaacatatggaacatgcacgaccatgggagaacatagacgagaaaaacgcagcgtagcattagtaccacatgtaggaatgggactagaaacaaggacagaaacatggatgagtagtgaaggagcatggaaacatgtacaaaggatagaaacatggatattaaggcatccaggatttacaatgatggcagctatattagcatatactataggtacaactcattttcaaagggcattaatatttattttattaaccgcagttactccatcaatgaccatgagatgtataggaatgagcaatagagatttcgtagaaggagtatcaggaggatcatgggtagatatagtattagaacatggatcatgtgttaccactatggctaaaaacaaaccaacgctagattttgaattaattaaaacagaagcaaaacaaccagcaacgttgagaaaatattgcatagaagcaaaattgacgaacaccacaaccgaatcaagatgtccaacccaaggagaaccaagcctaaatgaagaacaagacaaaagatttgtatgcaaacacagtatggtagatagaggatggggaaatggatgtggattgtcaggaaaaggcggaattgttacctgtgcaatgttcaggtgtaagaaaaacatggaaggtaaagttgttcaaccagaaaacctcgaatacactatagtaataactcctcattcaggtgaagaacatgcagtaggtaacgatacgggtaaacatgggaaagaaataaaaataactccacagagcagtataacggaagccgaattaacgggatacggaactgtaactatggaatgttcaccaagaacaggattagattttaatgaaatggttctactacaaatggaaaacaaggcttggctagtacacagacaatggtttttagaccttccattaccatggttgcctggagcagacacacaaggaagcaattggatacaaaaagaaactctagtaacatttaaaaatcctcatgcaaagaaacaagacgtagtagttcttggttctcaagaaggtgcaatgcataccgctcttacaggagctacagaaatccaaatgtcaagtggaaatctattatttacaggacacttaaaatgccgattaagaatggacaaactacagctaaaaggaatgagttattcaatgtgcacaggcaaatttaaagttgtaaaagaaatagcggaaacacaacacggaacaatcgtaattagagtacaatacgaaggagatggttcaccatgtaaaataccgttcgaaatcatggatcttgagaaaagacatgtactaggacgactgataacagttaatccaattgtaacagaaaaagattcacctgtaaatatagaagcagaacctccttttggagattcttatataataatcggtgtcgaaccaggacaactaaaactcaattggtttaagaaaggcagttcaataggacaaatgtttgaaacaacaatgagaggagcaaaaagaatggcaatattaggagataccgcatgggattttggttcattaggaggtgtatttacatctataggaaaagcattgcaccaagtattcggtgctatatacggagccgcattctcaggagtatcttggactatgaaaatactaataggagtcataataacatggataggaatgaactcaagatccacatctttaagcgtaactctagtattagtaggaatagtaacactatacttaggagtcatggtacaagcataa

SEQ ID NO: 2233 - RNA, 2043 nt, synthetic construct
  misc_feature 1..2043: note = derived and/or modified CDS sequence (opt6) from DENV-2 CYD2-T__SSopt-prME(M96H)
  source 1..2043: mol_type = other RNA
atgaaacgaaaaaaatcagctggaatgataattatgctaatacctacggtaatggcatttcacttaacaacaaggaatggtgaaccacatatgatagtatcaagacaagagaaaggaaaaagcctcttatttaaaacagaagatggagtaaacatgtgtactctaatggcaatggatttaggcgaactatgtgaagatactataacatataaatgtcccctcttaagacaaaatgaaccagaagatatagattgttggtgtaattcaacaagcacatgggtaacatatggaacatgtaccacaatgggagaacatagaagggaaaaacgttcagtagctctagtcccacatgtgggcatgggtctagaaacacgaacagaaacatggatgagcagtgaaggagcatggaagcatgtccaacgaatagaaacttggatattgcgacatccaggcttcactatgatggctgctatattagcctatacgattgggacaacgcattttcaaagggcattaatttttattttattaacagccgtgacaccgtcaatgacaatgagatgcataggtatgtctaatagagattttgtagaaggagtatcaggtggatcatgggtagatatagtactagaacatggatcatgtgttactacaatggcaaaaaataaaccaacacttgacttcgaattaataaaaacagaagcaaaacaaccagcaaccttaagaaaatattgtatagaagctaaactaacaaatacaacaacagaatccagatgtcccacacaaggagaacccagtttaaatgaagaacaagacaaacgattcgtatgtaaacattcacatgtggatagaggttggggtaatggatgtggattattcggaaaaggaggaatagtaacatgcgcaatgtttagatgtaaaaagaatatggaaggtaaagtagtacaaccagaaaatttagaatatactatagtcataaccccacatagtggagaagaacatgcggtaggaaatgacactggaaaacatggaaaagaaatcaaaattactcctcaatcatcaataactgaagcagaacttactggctatggaacggtaacaatggaatgttccccaagaaccggtttagactttaatgaaatggtattattacaaatggaaaataaagcatggctcgtacatcgacaatggttcttggatttaccattaccttggctacctggagccgatacacaaggatcaaattggatacaaaaagaaacgttagtaacctttaaaaatccacatgcaaaaaaacaagacgtagttgtactaggctctcaagaaggtgcaatgcacacagccttaacaggagcaacagaaatacaaatgagttccggaaatttactattcacaggacatctaaaatgtagattaagaatggataaactacaattaaaaggtatgtcatacagtatgtgtacaggtaaatttaaagtagtaaaagaaatagctgaaacacaacatggaacaatagtgataagagttcaatatgagggtgacggctcgccatgtaagataccatttgaaataatggatcttgaaaaaagacatgtactaggaagattaataacagtaaacccaatagtaaccgagaaagattcacctgtaaatattgaagccgaaccaccatttggagactcttatattataataggtgttgaacccgggcaattaaaattaaattggtttaaaaaaggaagttcaataggtcaaatgtttgaaacaacaatgagaggcgctaaaagaatggccatattaggagacacagcatgggacttcggctccctaggaggggtatttactagtataggtaaagcgttacaccaagttttcggcgctatatatggagcagcatttagtggcgtaagttggacaatgaaaattttaataggggtaataataacttggataggaatgaattctagatcgacaagtctaagtgtaaccttagtcctggtcggtatagtgactttatacctaggagtaatggtacaagcataa

SEQ ID NO: 2234 - RNA, 2043 nt, synthetic construct
  misc_feature 1..2043: note = derived and/or modified CDS sequence (opt6) from DENV-2 CYD2-T__SSopt-prME(S186F)
  source 1..2043: mol_type = other RNA
atgaaacgaaagaaaagtgcaggaatgataatcatgttaataccaacagtaatggcctttcatctaacaacacgaaatggagaaccgcatatgatagtctcaagacaagaaaaaggaaaatcactgctattcaaaacagaggatggagtaaatatgtgtacattaatggctatggatctaggtgaactatgtgaagacacaataacatacaaatgtccactattaagacaaaatgaacctgaagacatagattgctggtgcaatagtacctcaacgtgggtaacatacggcacatgtacaacaatgggtgaacatagaagggaaaagcggtccgtagcattagtaccacatgtaggaatgggtttagaaacaagaacagaaacatggatgagctcagaaggggcatggaaacatgtacaaagaatagaaacttggattcttcgacaccctggatttacaatgatggcagcaatactagcatatacaataggaacaacacacttccaaagagcattaatatttattttactcacagccgtaacaccaagtatgaccatgagatgtataggaatgagcaatagagattttgtggaaggtgtatcaggcggatcatgggtagatattgtattagaacatggatcatgtgttaccactatggccaaaaataaacccacattagactttgaactaattaaaactgaagcaaaacaaccagcaacactccgcaaatattgtatagaagccaaattaacaaatacaacaacagagtcgagatgccctacacaaggagaaccaagtttaaatgaagaacaagacaaaagatttgtgtgtaaacattcaatggtcgacaggggatggggaaatggttgtggattatttggtaaaggaggcatagtaacatgtgctatgttccgatgcaagaaaaacatggaaggaaaagtagtacagccagaaaatttagagtacacaatagtaataacaccacactcgggagaggaacatgcagtgggtaatgatacaggaaaacatgggaaagaaataaaaattacaccacaaagctcaataacagaagcagaattaactggatatggaacagtcacgatggaatgtttccctagaacaggcttagatttcaacgaaatggtacttttacaaatggaaaataaagcatggcttgtacatagacaatggtttttggatttaccattaccatggttacctggtgctgatactcaaggctcaaattggatacaaaaagaaacgctagtaacattcaaaaatccacacgcgaagaaacaagatgtagtagttctaggatcacaagaaggagcaatgcatacggcactaacaggagctacagaaatacaaatgtcaagtggaaacctattatttacaggacacctaaaatgcagactaagaatggataaattacagttaaaaggaatgtcatatagcatgtgtacagggaaatttaaagtagtgaaagaaatagcggaaacgcaacatggcacaatagtaataagagtacagtatgaaggagatggatctccctgcaaaataccctttgaaataatggacttagagaaaagacacgtactaggaagattaatcacagtaaatccaatagtcacagaaaaagactctccagtaaacatagaagctgaaccacccttcggagattcctacataataataggagtcgaaccaggacaattaaaactaaactggttcaagaaaggatcttcaataggtcaaatgttcgaaacaactatgaggggtgcaaaacgaatggcaatcttaggtgatacagcttgggactttggtagtttaggtggagtatttacaagcataggaaaagccctacaccaagtatttggcgcaatatacggagcagcattttcaggagtaagctggacaatgaaaatacttataggagtgataattacatggataggaatgaactcacgatcaacatcactaagcgtaacattagtattagtaggaattgtaacattgtatttaggtgtaatggtacaagcctaa

SEQ ID NO: 2235 - RNA, 2043 nt, synthetic construct
  misc_feature 1..2043: note = derived and/or modified CDS sequence (opt6) from DENV-2 CYD2-T__SSopt-prME(R188L)
  source 1..2043: mol_type = other RNA
atgaaaagaaaaaaatcagccggaatgataataatgctgataccaacagtaatggcatttcatttaacaacaagaaacggagaaccccacatgatagttagtagacaagaaaaaggtaagtcactgctttttaaaacagaagacggagtgaacatgtgcacattaatggctatggacctaggcgaattatgtgaagatacaataacttataaatgcccattactaagacaaaatgaaccagaggatatagattgttggtgtaattcaacatcaacttgggtcacttatggtacttgcaccaccatgggagaacatcgaagagaaaaacgtagtgtcgcattagtaccacacgtaggaatgggtttagaaacacgaaccgaaacttggatgtcaagtgaaggcgcatggaaacatgtacaacgtatagaaacttggatactaagacatcccggatttacaatgatggcagcaatattagcttatacaatcggaaccacacactttcaacgagcattgatattcatattattaacagctgttacaccaagcatgacaatgagatgcataggtatgtcgaatagagattttgttgaaggagttagtggaggatcttgggtggacattgtattagaacatggttcctgtgtaacaacaatggctaaaaacaaaccaacattagattttgaattaataaaaacagaggcaaaacagccggctaccctaagaaaatattgtatagaagcaaaactaacaaacacaacgacagaaagtcgatgtcccacacaaggagaacctagcttaaatgaagagcaagataaaagatttgtttgtaaacatagtatggtagatagaggatggggaaatggctgtggactatttggaaaaggaggaatagtgacatgtgcaatgtttcgatgtaaaaaaaacatggagggaaaagtagtacagccagaaaatctggaatacacaattgtaataacaccacactcaggagaagaacatgccgtaggtaacgatacaggaaaacatggaaaagaaataaaaataacaccacagagttcaataacagaagctgaattaactggatatgggacagtaacaatggagtgtagtccacttacaggattagattttaacgaaatggtacttctacaaatggaaaacaaagcatggttagtacatagacaatggtttttagatttaccattaccctggctacctggtgctgatacacaaggaagtaactggatacaaaaagaaacattagtaacattcaaaaacccacatgctaaaaaacaagatgtagtagtattaggatcacaggaaggagcaatgcacacagcattaactggggcaacagaaatacaaatgagcagcgggaacttattattcacaggacacctaaaatgtagacttagaatggacaaattacaattaaagggaatgtcatatagtatgtgcacaggaaaatttaaagttgtaaaagaaattgcagaaacacaacatggcacaatagtaataagagtacaatatgaaggggatggaagtccatgcaaaataccattcgaaataatggatttagaaaaaagacatgtacttggtcgcttaataacagtaaaccctatagtcactgaaaaagattctcctgtaaatatagaagctgaaccaccattcggagacagttacataataataggagtagaaccaggtcaactaaaattaaattggtttaaaaaaggatcaagtataggacaaatgtttgaaacaacaatgagaggggcaaagcgaatggctatactaggagatacagcatgggattttggatccctagggggagtatttaccagcatagggaaagcattacatcaagtattcggagccatctatggtgcggcattttctggtgttagttggacaatgaaaattctcataggagtaataataacctggataggaatgaactcaagatccacatcactgtcagtaacacttgtgcttgttggaatagtaacactatacttaggagtcatggtacaagcataa

SEQ ID NO: 2236 - RNA, 2043 nt, synthetic construct
  misc_feature 1..2043: note = derived and/or modified CDS sequence (opt6) from DENV-2 CYD2-T__SSopt-pr(D104A)MEdelstem_TM,(F108S)-JEV
  source 1..2043: mol_type = other RNA
atgaaacgcaaaaaatcagcaggaatgataataatgttgattccaactgttatggcttttcatctaaccacaaggaatggagaaccacatatgatagtttctcgacaagaaaaaggaaaatcactcctttttaaaacagaagatggagtaaatatgtgcacactaatggcaatggacctaggggaactatgtgaagatacaataacttataaatgtccattgctaagacaaaacgaaccagaagatatagactgttggtgcaattcaactagtacgtgggtaacttatggtacatgcacaacaatgggagaacatcgcagagcaaaacgatctgtcgcattagtaccacatgtaggtatgggattggaaactagaacagaaacatggatgagttcggaaggtgcatggaaacacgtacaaagaatagaaacctggatattacgacatcctggatttacaatgatggcagcaatactagcttacaccataggaacaacacactttcaaagagcactaatatttatattgctaacagcagtgacaccaagcatgacaatgagatgtattggaatgagcaacagagacttcgtagaaggagtgtcaggtggatcatgggtggacatagtattagagcatggtagctgcgtaacaacaatggcaaaaaataaaccaaccctagattttgaactgataaaaacagaagcaaagcaaccagcaacactaagaaaatattgtattgaagcgaaattaacaaacactacaacagaaagtagatgtccaactcaaggagaaccgtcgctaaacgaagaacaagataaacgtttcgtgtgcaaacacagcatggttgataggggatggggaaatggatgcggactatcaggaaaaggaggaatagtaacctgtgcgatgtttagatgtaaaaaaaatatggaaggaaaagtagtacaacccgaaaatttagagtacacaatagtaataaccccgcattcaggagaagaacatgcagtgggcaatgacacaggtaaacatgggaaagaaattaaaataactcctcaaagctctataacagaagcagaattaacaggctatggaaccgtaacaatggaatgtagtccaagaactgggctagattttaatgaaatggtattattacaaatggaaaataaagcatggttagtacatcgacaatggtttttagatttacctctaccatggttaccaggggcagatacacagggatcaaattggattcaaaaagaaacacttgtaactttcaaaaacccacatgctaaaaaacaagacgttgtagttctgggaagtcaagaaggagcaatgcatacggcattgacaggagcaacagaaatacaaatgagtagcggaaaccttctctttacaggacatttaaaatgccgattaaggatggataaattacaattaaaaggaatgagctatagtatgtgtacaggaaaatttaaagtagtaaaagaaattgcagaaacacaacacggaacaatagtaataagagtacaatacgaaggggatggaagtccttgtaaaataccatttgaaataatggatttagaaaaaagacacgttttaggaagactaatcacagttaatccaatagtaactgaaaaagacagcccagtaaatatagaagccgaaccaccatttggagattcatatataattataggggtagaacctggacaattaaaactaaattggtttaaaaaaggatctacgctaggaaaagcatttagcactactctaaaaggagctcaaaggctagcagctttaggagatacagcatgggattttggttcaataggtggggttttcaattcaataggaagagcggtacaccaagtattcggaggagcattccgaacattattcggcggaatgagctggataacacaaggactcatgggagcattattattgtggatgggagtaaatgcaagggacagaagcatagcactagcatttcttgcaaccggtggtgtattagtattcctagctacaaatgtacatgcttaa

SEQ ID NO: 2237 - RNA, 2043 nt, synthetic construct
  misc_feature 1..2043: note = derived and/or modified CDS sequence (opt6) from DENV-2 CYD2-T__SSopt-prMEdelstem_TM,(H261N)-JEV
  source 1..2043: mol_type = other RNA
atgaaacgaaaaaaatcagccggaatgataataatgttaataccaacagtcatggcatttcacctaacaacgagaaatggagaacctcatatgatagtatcacgccaagaaaaaggaaaaagtctattatttaaaactgaagatggtgtaaacatgtgcacattaatggcaatggacttaggagaattatgtgaagacacaataacatataaatgtcctttattacgtcaaaatgaacctgaagacatcgactgttggtgcaatagtacaagcacatgggtaacatatgggacatgtactaccatgggagaacatagaagagaaaaaaggagtgtagcattagtaccacatgtaggtatgggtcttgaaacaagaacagagacatggatgagttcagaaggagcatggaaacatgtacaaagaatagaaacgtggatacttagacatcctggctttactatgatggcagcaatattagcttatactatcggaactactcattttcaaagagcactaatcttcatattactcacagcagtaacaccaagcatgacaatgagatgtataggaatgagtaaccgagattttgtagaaggagtatcaggagggtcatgggttgatatagtgttagaacatggatcatgtgttacaactatggcaaaaaataaaccaacacttgactttgaactaataaaaacagaggcaaaacaaccagcaacattaaggaaatactgcatagaagcaaaactaacaaatactacaacagagagcagatgtcctacacaaggagaaccgtcattaaatgaggaacaagataaaagatttgtttgtaaacatagcatggtagacagaggatggggaaacggatgtggattattcggaaaaggaggaatagtaacgtgtgcaatgtttcgctgtaaaaaaaatatggaaggcaaggtagtacaaccagaaaatttagaatatactatcgttataacaccccattcaggtgaagagcatgctgtgggaaacgacacaggtaaacatggtaaagaaataaaaataacaccacaaagtagcataacagaagcagaactaactggatatggaactgtaacaatggaatgttcaccacgtactggcttagattttaatgaaatggtattattacaaatggaaaataaggcatggttagtacatagacaatggtttctagatctaccacttccatggctaccaggagcagatacacagggatctaattggattcaaaaagaaactttagttacctttaaaaaccctcatgctaaaaaacaagatgttgtagttttgggaagtcaagaaggagccatgaatacagcactcacaggcgcaacagaaattcaaatgtcttctggaaacctattattcacaggacatctaaaatgtagattaagaatggacaaattacaattgaagggtatgtcttatagcatgtgcacaggaaaatttaaagtagtgaaagaaatagctgaaactcaacacggtacaattgtaataagggtacaatatgaaggagacggttcaccttgcaaaataccatttgaaataatggacttagaaaaacgacacgtattaggaagacttataactgtaaatccaatagtgactgaaaaagattcaccagtaaatatagaagctgaaccaccatttggagattcatacataataataggagtagaaccgggacaactaaaattaaactggttcaaaaaaggaagcacactaggtaaagcattctcaacaactctaaaaggagcacaaagattagccgcattaggagatacagcatgggatttcggttcaattggaggggtatttaattctataggaagagcagtccatcaagtatttggtggagcatttagaacactatttggcggaatgtcatggattactcaaggattaatgggagcacttttattatggatgggagtaaacgccagagatagatcaatagcgcttgctttcttagcaaccggtggagtattggtatttttagcaacaaacgttcacgcataa

SEQ ID NO: 2238 - RNA, 2043 nt, synthetic construct
  misc_feature 1..2043: note = derived and/or modified CDS sequence (opt6) from DENV-2 CYD2-T__SSopt-prMEdelstem_TM,(R188L,A267T)-JEV
  source 1..2043: mol_type = other RNA
atgaaaagaaagaaatcagcaggaatgattataatgctaatacccacagttatggcatttcatctaacaacacgaaatggagaaccccatatgatagtaagcagacaagaaaaaggaaaaagtttattatttaaaacagaagatggtgtaaacatgtgtaccctaatggcaatggatttaggtgaattatgtgaagatacaataacatataaatgcccactactaagacaaaacgaaccagaagatatagattgctggtgcaatagcacaagcacatgggttacatatggaacatgtaccacaatgggagaacacagacgagagaaacgatcagtagctctagtacctcatgtaggaatgggactagaaacaagaacagaaacatggatgagttcagaaggagcatggaaacacgtccaaagaattgaaacgtggatactaagacacccagggttcacaatgatggcagctatactagcatatacaataggaacaactcatttccaaagggcactgatatttatattattaacagcagtaacaccaagtatgacaatgcgatgcataggcatgagcaatagagattttgtagaaggcgtctctggtggaagctgggttgacatagtattagaacatggaagctgtgttactacaatggcgaaaaacaaacctactttggactttgaacttattaaaacagaagcaaaacaaccggcaacattaagaaaatactgtatagaagcaaaactgacaaacacaaccacagaatccagatgtccaacccagggagaaccaagtttaaatgaagaacaagacaaaaggtttgtatgcaaacactcaatggtagacagaggctggggaaatggctgtggtctttttggtaaaggaggaattgttacatgtgcaatgtttagatgtaagaaaaacatggaaggtaaagttgtacaacctgaaaatttagaatataccattgtaataaccccacattccggagaagaacatgcagtaggaaacgatactggaaaacacggaaaagaaattaaaattacaccacagagctcaattactgaagctgaattaacaggctacggaaccgtaacaatggaatgtagtccattaacaggacttgattttaatgaaatggtattactacaaatggaaaacaaagcatggctggtacacagacaatggttccttgatctaccacttccatggctcccaggagcagatacgcaaggtagtaattggatacaaaaagaaactctagtgactttcaaaaacccgcacgctaagaaacaggatgtagtagttttgggatcacaagaaggagcaatgcacactgcattaacgggaacaactgaaatacaaatgagttccggtaatttgctatttacaggacacctaaaatgtagacttaggatggacaaattacagttaaaaggaatgagttattctatgtgtacaggaaaatttaaagtagtgaaagaaatcgcagaaacacaacatggaacaattgtaattagagtacaatatgaaggagatggatcaccatgtaaaatcccatttgaaataatggatctagagaaaaggcatgtattaggtagactaataacagtaaatcccatagtcacggaaaaagattccccagtaaacatagaagcagaaccaccttttggagatagttatatcattataggagtagaaccagggcaattaaaactaaattggtttaagaaaggaagtactctaggaaaagcatttagtactacacttaaaggagcgcaaagactagcagcactaggagacacggcctgggactttggatcaataggcggcgtatttaactcaatcggcagagcagtacaccaagtattcggaggagcatttagaacattgtttggaggaatgtcatggataacacaaggattaatgggagcattattattatggatgggagtaaatgcaagagatagaagcattgcattagcatttttagctacaggaggagtattagtattcttagccacaaatgtacacgcataa

SEQ ID NO: 2239 - RNA, 297 nt, synthetic construct
  misc_feature 1..297: note = derived and/or modified CDS sequence (opt6) from DENV-4 Consensus__C
  source 1..297: mol_type = other RNA
atgaaccaaagaaaaaaagtagtaagaccaccatttaacatgctaaaaagagaaagaaacagagtaagcacaccacaaggactagtaaaaagattcagcacaggattattctcaggaaaaggaccactaagaatggtactagcattcataacattcctaagagtactaagcataccaccaacagcaggaatactaaaaagatggggacaactaaaaaaaaacaaagcaataaaaatactaataggattcagaaaagaaataggaagaatgctaaatatattaaacggacgaaaaaga

SEQ ID NO: 2240 - RNA, 339 nt, synthetic construct
  misc_feature 1..339: note = derived and/or modified CDS sequence (opt6) from DENV-4 Consensus__C-SSc
  source 1..339: mol_type = other RNA
atgaaccaaagaaaaaaagtagtaagaccaccattcaacatgctaaaaagagaaagaaacagagtaagcacaccacaaggactagtaaaaagattcagcacaggactattctcaggaaaaggaccactaagaatggtactagcattcataacattcctaagagtactaagcataccaccaacagcaggaatactaaaaagatggggacaactaaaaaaaaacaaagcaataaaaatactaataggattcagaaaagaaataggaagaatgctaaacatactaaacggaagaaaacgatcaacaataacactactatgcctaataccaacagtaatggca

SEQ ID NO: 2241 - RNA, 273 nt, synthetic construct
  misc_feature 1..273: note = derived and/or modified CDS sequence (opt6) from DENV-4 Consensus__pr
  source 1..273: mol_type = other RNA
tttcacttaagcacaagagacggagaaccattaatgatagtagcaaaacatgaaagaggaagaccattactatttaaaacaacagaaggaataaacaaatgcacactaatagcaatggacttaggagaaatgtgtgaagacacagtaacatataaatgtccattactagtaaacacagaaccagaagatatagactgctggtgcaatctaacaagcacatgggtaatgtatggaacatgcacacaatcaggagaaagaagaagagaaaaaaga

SEQ ID NO: 2242 - RNA, 225 nt, synthetic construct
  misc_feature 1..225: note = derived and/or modified CDS sequence (opt6) from DENV-4 Consensus__M
  source 1..225: mol_type = other RNA
agtgtagcattaacaccacatagtggaatgggattagaaacaagagcagaaacatggatgagtagtgaaggagcatggaaacatgcacaaagagtagaaagttggatattaagaaatccaggatttgcattattagcaggatttatggcatatatgataggacaaacaggaatacaaagaacagtattttttgtattaatgatgttagtagcaccaagttatgga

SEQ ID NO: 2243 - RNA, 498 nt, synthetic construct
  misc_feature 1..498: note = derived and/or modified CDS sequence (opt6) from DENV-4 Consensus__prM
  source 1..498: mol_type = other RNA
tttcatttaagtacaagagatggagaaccattaatgatagtagcaaaacatgaaagaggaagaccattattatttaaaacgacagaaggaataaataaatgtacattaatagcaatggacttaggagaaatgtgtgaagatacagtaacatataaatgtccattattagtaaatacagaaccagaagatatagattgctggtgtaatttaacaagtacatgggtaatgtatggaacatgtacacaatcaggagaaagaagaagagaaaaaagaagtgtggccttaacaccacactcaggaatgggattagaaacaagagcagaaacatggatgagctcagaaggagcatggaaacatgcacagagagtagaaagttggatattaagaaatccaggatttgcattattagcaggatttatggcatacatgataggacaaacaggaatacaaagaacagtattctttgtattaatgatgttagtagcaccaagttatgga

SEQ ID NO: 2244 - RNA, 1485 nt, synthetic construct
  misc_feature 1..1485: note = derived and/or modified CDS sequence (opt6) from DENV-4 Consensus__E
  source 1..1485: mol_type = other RNA
atgagatgtgtgggagtaggaaacagagactttgtagaaggcgtaagtggcggagcatgggtggatttagtattagaacatggaggatgcgtaacaactatggcgcaaggaaaaccaacacttgattttgaacttacaaaaacaacagctaaagaagtagccttattaagaacttattgtattgaagcaagtatatcaaacataacaacagcaactagatgtccaacacaaggagaaccatatttaaaagaagaacaagaccaacaatacatatgtcgaagagatgtagtagatagaggatggggtaatggatgtggattatttggaaaaggaggtgtagttacatgtgcaaaatttagctgcagtggaaaaataacaggaaatttagtgcaaatagaaaatttggaatatacagtcgtagtaacagtgcataatggagatacacatgcagtaggaaatgatacaagtaatcacggagttacggcgacgataacaccaagatcacctagcgtagaagttaaattaccagattatggagaattaacgctagattgtgaacctagatcgggcatagactttaatgaaatgatattaatgaaaatgaaaaagaaaacatggttagtacacaaacaatggtttctagacttaccattaccatggacagcaggagcagacacgtcagaagtacattggaactataaagaaagaatggtaacatttaaagtaccacatgctaaaagacaagacgtaacagtactcggaagccaagaaggagcaatgcacagcgcattagcgggagcaacagaagtagatagtggagatggaaaccatatgtttgcgggacacttaaaatgtaaagtaagaatggaaaaacttagaattaaaggaatgagctatactatgtgttcaggaaaatttagtatagacaaagaaatggcggagacacagcacggaacaacagtagtgaaagtaaaatacgaaggagcaggagcaccgtgtaaagtgccaatagaaataagagatgttaataaagagaaagtagtaggaagagtgataagtagtacaccacttgctgaaaacacaaacagtgtaactaatattgaattagaaccgccatttggtgactcatacatagtgattggagtaggaaattcagcattaacactgcactggtttagaaagggatcaagtattggcaaaatgtttgaaagcacatatagaggagcaaaaagaatggcaatattaggagaaacagcatgggactttggaagtgtaggaggattattcacaagtctagggaaagccgtacaccaagtatttggaagtgtatatacaacaatgtttggaggggtatcatggatgataagaattttaataggatttttggtactatggataggaacaaatagtagaaatacaagtatggcaatgacttgcatagcagtaggaggaataacattattcttgggattcacagtacaagca

SEQ ID NO: 2245 - RNA, 1983 nt, synthetic construct
  misc_feature 1..1983: note = derived and/or modified CDS sequence (opt6) from DENV-4 Consensus__prME
  source 1..1983: mol_type = other RNA
ttccatttatctacccgtgacggtgaaccactaatgattgtagcaaaacatgaaagaggaagaccattactatttaaaacgacagagggtataaataagtgtacattaattgcaatggatttaggagaaatgtgtgaagataccgtaacatataaatgtccattattagtaaatactgaaccagaagatatcgactgttggtgtaatctaacaagtacatgggtaatgtatggaacatgtacacaaagtggagaaagaaggagagagaaaagatcagtagcattaactccccactctggaatgggattagaaaccagagcagaaacttggatgagtagtgaaggagcatggaaacatgcacagcgtgtagaatcatggatattaagaaatccaggatttgctctacttgcaggatttatggcatatatgataggacaaacaggaatacagcgaacagtattctttgtattgatgatgttagttgcacctagttatggaatgagatgcgttggagtaggaaatagagattttgtagaaggagtaagtggtggagcatgggtagatctagtattagaacatggaggatgtgttactacaatggcacaaggaaaaccaacattagattttgaactaacaaaaacgacggcgaaagaagtagcactactaagaacctattgcatagaggcttcaatatcaaatataactacagcgacaagatgcccaacacaaggagaaccatatctaaaagaagaacaagatcaacaatatatttgtagacgagatgtagtggatagagggtggggaaatggatgtggattgtttggaaaaggaggagttgtaacatgtgcaaaattctcatgctcaggaaaaattactggcaatttagtacagatagaaaatttagagtatacagtagtagtaacagtacataatggagatacacacgctgtaggaaatgacacaagcaatcacggagtcacggcaactatcacaccaaggagcccttctgtagaggttaagctaccagactatggagaattaacactagactgtgagcctagaagcggcatagatttcaatgaaatgatacttatgaaaatgaaaaagaaaacatggttggtgcataaacagtggtttctggatctaccattaccatggacagcaggcgctgacacatcagaagtacattggaattataaagaacgaatggtaacgttcaaagtaccacatgcaaaacggcaagatgtgacagtactaggatcacaagaaggagcaatgcattcagcgctagctggagcaacagaagttgatagtggagatggaaatcatatgtttgcaggacacctaaaatgcaaagtaagaatggaaaagttaagaataaaggggatgagttatacgatgtgctcaggaaaattcagtatcgataaagaaatggcagaaactcaacatggaacaacagtagtaaaagttaaatatgaaggtgccggtgctccatgtaaagtcccaattgagattcgagatgtaaataaagaaaaagtggtaggaagagtaataagttcaacaccattagcagagaatactaatagtgtaacaaatatagaattagaaccgccttttggagattcatatatagtaataggtgtaggaaattcagcattaactttacactggtttagaaaaggaagctcaattggaaaaatgtttgaatctacgtataggggagctaaacgaatggcaatattgggagaaaccgcatgggattttggaagcgtaggcgggttatttacgagcctgggaaaagcagtacaccaagtattcggtagtgtatacacaacaatgttcggaggagtgtcatggatgatacgaattttgataggatttctagtattatggataggaactaatagcagaaatacaagtatggcaatgacatgtattgcagttgggggaataacattatttttaggattcacggtacaagca

SEQ ID NO: 2246 - RNA, 2025 nt, synthetic construct
  misc_feature 1..2025: note = derived and/or modified CDS sequence (opt6) from DENV-4 Consensus__SSc-prME
  source 1..2025: mol_type = other RNA
tcaacaattaccttattatgtctaataccaacagtaatggcatttcatttatcaactagagacggtgaaccattaatgatagttgcaaaacacgaaagagggagaccattgctttttaaaacaacagaaggtataaacaaatgcacattaatagcaatggacttaggtgaaatgtgcgaagatacagtaacttataaatgcccattattagtaaatactgaaccggaagatatagactgctggtgcaatttaacaagcacctgggtaatgtacggaacttgcactcaatcaggtgaaagaagaagagagaaaaggtcagttgcattgactcctcattcaggaatgggactagaaacaagagctgaaacctggatgagctcagaaggagcttggaaacacgcgcaaagagttgaaagttggatactaagaaacccaggctttgcattattagctggatttatggcttatatgataggacaaacaggaatacaaagaacagttttctttgtattaatgatgctcgttgcaccaagttacggaatgaggtgtgttggcgtaggtaatagagattttgtagaaggagtatctggaggagcatgggtagatttagtattagaacatggtggctgtgtaacaacaatggcacaaggaaaaccaacgttagactttgaattaacaaaaactacagctaaagaagtagcacttttgagaacatattgtatagaagcaagtataagcaatataactacggcgacaagatgccccacacaaggtgaaccatacctgaaagaagaacaagatcaacaatatatttgcagacgagacgtagtcgatcgaggatggggaaatggttgcggattatttggaaaagggggagtagtaacatgcgcaaaattttcatgctcaggtaaaataacaggaaatttagtacagatagaaaacttagaatatacagtggttgtaacagtacacaatggggatacacatgcagtaggaaatgacacttcaaatcatggagtaacagcaacaataacaccaagatctccaagcgtagaggtaaaattaccagattatggtgaacttactttggattgtgaacccagaagtggaatagacttcaatgaaatgatattaatgaaaatgaaaaagaaaacatggcttgtacataaacaatggtttcttgacctacccttgccatggactgcgggagcagatactagcgaagtacattggaattataaagaaagaatggtcacctttaaagtaccacatgcaaaaagacaagacgttacggtactaggaagccaagaaggagcaatgcattccgccctcgcaggcgcaactgaagtagattcaggcgatggaaatcatatgtttgcgggtcatttaaaatgtaaagtaaggatggagaaattaagaataaaaggaatgagctatacaatgtgtagtggaaaattttcaatagataaagaaatggcagaaactcaacatggtacaacagtagttaaagttaagtatgaaggagcaggagccccatgtaaagtgccaatagaaatacgagatgtaaataaggaaaaagttgttggaagagttatatcatcaacaccattagcagaaaacacaaattcagtaactaatatagaattagaacctccctttggagattcatatatagtcataggagtgggaaactcagcattaacacttcactggtttagaaaaggatcatcaattggaaaaatgtttgaatctacatatagaggtgcgaaaagaatggcaatattaggagaaacagcatgggattttggaagcgtaggagggttattcacaagccttggaaaggcagttcaccaagtattcggaagcgtctatacgacaatgtttggaggagtatcatggatgatcagaatattaataggattcctagtgttatggataggaactaactcaagaaacacaagcatggcaatgacctgtatagcagttggaggaataacgttatttctaggatttacagttcaagca

SEQ ID NO: 2247 - RNA, 2322 nt, synthetic construct
  misc_feature 1..2322: note = derived and/or modified CDS sequence (opt6) from DENV-4 Consensus__C-prME
  source 1..2322: mol_type = other RNA
atgaatcaacgaaagaaagtagtgaggccgccatttaatatgttaaaaagggaacgaaatcgagtttcaacaccacaaggattagtaaaaaggttctcaacaggcctattcagtggaaaaggaccgcttagaatggttctagcatttataacatttttaagggtattgtcaatcccacccactgcgggaatcttaaaaagatggggacaattaaagaaaaacaaagctatcaaaatattaataggatttagaaaagaaattgggcgaatgcttaatatattaaatgggagaaaaaggtcaactataacattattatgtctaatacccacagtaatggcattccacttatcaaccagagatggtgaacccttaatgattgtggcaaaacatgagaggggaagaccattattatttaaaactactgaaggaattaacaaatgtacattaatagctatggacttaggcgaaatgtgtgaagacacagttacatataaatgtccgttattagtaaatacagagccagaagacatagattgctggtgtaatctcacaagcacgtgggtaatgtatggtacatgtactcaatcaggcgaaagaagaagagagaaaagatcggttgcactgactccgcactccggaatgggattagaaacaagagctgaaacgtggatgtcgtcggaaggggcatggaaacatgctcaaagagtagaatcttggatattacggaatccaggctttgcactcctagcgggatttatggcttatatgataggacaaacggggatacaacgaacagtatttttcgtcctaatgatgctagtcgctccatcatatggtatgagatgtgttggagtaggaaaccgagactttgtcgaaggtgtctcagggggagcttgggtagatttagtgctagaacatgggggatgtgtaacaacaatggctcaaggtaaacctactttagactttgaacttactaaaacaaccgcaaaagaagtagctttattaagaacatattgcatagaagcatcaatatcaaatattacaacggcaaccagatgtccaacacaaggagaaccctatttaaaagaagaacaggatcagcaatatatttgcagaagagatgtagtagatcgaggttggggaaacgggtgcggattatttggaaaagggggcgtagtaacatgcgctaaattctcttgctctggaaaaattacaggaaacttagtccaaatagaaaacttagaatatacagtagtagttactgtacataatggagatacccacgccgtcggaaatgatacttctaaccatggagtcacagcaacaataacaccaaggtcaccatcagttgaagtaaaactacctgattatggagaattaactttagattgtgaaccaagatcagggatagattttaatgaaatgatactaatgaaaatgaagaagaaaacatggttagttcataaacaatggtttttagatctaccattaccctggacggcaggagccgatacctcagaagtacactggaattataaagaacgtatggtaactttcaaagtgcctcacgccaaaagacaagatgtaacagtactaggcagccaagaaggtgcaatgcatagtgcgctagcaggagcaacagaagtagatagcggggacggcaatcatatgtttgcaggacacttaaaatgcaaagtaagaatggaaaaattaagaattaaaggaatgtcctatacaatgtgtagtggaaaattttcaattgataaagaaatggcagaaacgcaacacggaaccacagtagtaaaagtaaaatatgaaggagctggtgcaccttgcaaagtaccaatagaaataagggatgtaaataaagaaaaagtagtcggaagagttataagctctacaccattagccgaaaacacaaatagcgtaacgaatatagaattagaaccaccatttggagattcatacattgtcataggagtaggcaattccgcattaacactacactggttcaggaaaggtagttcaataggaaaaatgtttgaaagtacataccgaggagcaaaaagaatggcaatattaggtgaaacagcttgggactttggatcagtaggaggtttatttacaagcctgggaaaggcagtacatcaagttttcggatcagtgtatacaacaatgtttggaggtgtatcgtggatgataaggatactgataggattcttagtattatggataggaaccaacagtagaaatacatcaatggctatgacatgcatagcagtaggaggaataacattgtttttgggatttacagtacaagca

SEQ ID NO: 2248 - RNA, 45 nt, synthetic construct
  misc_feature 1..45: note = derived and/or modified CDS sequence (opt6) from DENV-4 Consensus__SSc
  source 1..45: mol_type = other RNA
atgtccacaatcacactcctatgcctaatcccaaccgtaatggca

SEQ ID NO: 2249 - RNA, 57 nt, synthetic construct
  misc_feature 1..57: note = derived and/or modified CDS sequence (opt6) from DENV-4 Consensus__SSopt
  source 1..57: mol_type = other RNA
atgaaaagaaaaaaaagcacaataacactactatgcctaataccaacagtaatggca

SEQ ID NO: 2250 - RNA, 57 nt, synthetic construct
  misc_feature 1..57: note = derived and/or modified CDS sequence (opt6) from DENV-4 Consensus__SSm
  source 1..57: mol_type = other RNA
atgatacaaagaacagtatttttcgtactaatgatgttagtagcaccatcatacgga

SEQ ID NO: 2251 - RNA, 1488 nt, synthetic construct
  misc_feature 1..1488: note = derived and/or modified CDS sequence (opt6) from DENV-4 Consensus__E
  source 1..1488: mol_type = other RNA
atgagatgtgtaggagtaggaaacagagactttgtagagggagtaagtggtggagcatgggtggatttggtcttagaacatggaggttgcgtaacaacaatggcacaaggaaaaccaacactagactttgaattaacaaaaacaacagctaaagaagtagcattattaagaacttactgtatcgaagcaagtataagtaatataacaacagcaacaagatgcccaacccaaggggaaccttatctaaaagaagaacaagatcaacaatatatatgtagacgagatgtagtagacagaggatggggaaatggatgtggattatttgggaaaggaggagtagtaacgtgtgctaaattcagctgtagcggaaaaataactggaaacttagttcaaatagaaaacctagaatacacagtagtagtaacagtacataacggcgacacacatgcagtaggaaacgatacgagtaaccacggtgtaacagctactataactccgagaagtccaagcgtggaagtaaaattacctgattatggagaactaacattagattgcgaaccaagatcaggaatagattttaatgaaatgatactaatgaaaatgaaaaagaaaacctggctagttcataaacaatggttcctcgatcttccacttccatggacagcaggagcagatacatcagaagtccattggaattataaagaaagaatggttactttcaaagtgccacatgcaaaaagacaagatgttacagtattaggatcgcaagaaggagcaatgcatagtgctctagcaggagctactgaagtagatagtggagatggaaatcatatgtttgctgggcacttaaaatgtaaagtaagaatggaaaaattacgaataaaaggaatgagttatacaatgtgcagtggcaaatttagtatagataaagaaatggcagaaacccaacacggaacaacagtagttaaagtaaaatatgaaggagcgggagcaccttgtaaagtaccaatagagataagagacgtaaataaagagaaagtagtcggacgtgtaataagtagtaccccattggcagaaaacacaaatagtgttacaaacatagagttagaaccaccatttggagatagttatatagtaattggcgtaggaaatagcgcactaacattacactggtttagaaaaggaagcagtatagggaaaatgtttgagagcacatatagaggtgctaaaagaatggcaatattaggtgaaacggcatgggatttcggtagtgtgggaggactatttacatcattaggaaaagcagtacatcaagtatttggaagcgtatacacgacaatgttcggaggagtaagctggatgataagaatattaataggctttttagtgttatggataggaacaaatagtagaaatacaagtatggcaatgacatgtatagcagtgggaggaataactttatttctaggattcacagtacaagcataa

SEQ ID NO: 2252 - RNA, 1182 nt, synthetic construct
  misc_feature 1..1182: note = derived and/or modified CDS sequence (opt6) from DENV-4 Consensus__EdelTM-variant (aa1-394)
  source 1..1182: mol_type = other RNA
atgagatgtgtaggagtaggaaaccgtgattttgtagaaggagtaagcggaggggcttgggtagatttagtgttagaacatggaggttgtgtaacaacaatggcacaaggaaaaccaacattagattttgaattaacaaaaacaacagcaaaagaagtggcactactaagaacatattgtatagaagcaagtataagtaatataacaacagcgacacgatgcccgacacaaggagaaccatacctaaaggaagaacaagatcaacaatatatatgtagaagggatgtggtagacagggggtggggaaatggatgtggtctttttggaaaaggaggggtagtaacatgtgcaaaatttagctgttcaggaaaaataacaggaaacctagtacaaatagaaaatctagaatatacagtagtagttacagtacataatggagatactcacgcagtaggaaatgatacatcaaaccatggagtaacagcaacaataacaccaagaagtccaagcgttgaagtaaaattaccagattacggagaattaacattagactgtgaaccaagaagtggaatagactttaatgaaatgatattaatgaaaatgaaaaagaaaacatggctagtacacaaacaatggtttttggatttaccattaccatggacagcaggggcagatacaagtgaagttcactggaattataaagaaagaatggtaacatttaaagtaccacatgcgaaaagacaagatgtgacagtcttagggagccaagaaggagcaatgcatagcgcactagcaggagcaacagaagtagattcaggagatggaaaccatatgtttgcaggacacctaaaatgcaaagtaagaatggaaaaactaagaataaaaggaatgagttatacaatgtgtagcggaaaatttagtatagacaaagaaatggcagaaactcaacatgggacaacggtagtgaaagtaaaatatgaaggagcaggagcaccatgcaaagtaccaatagaaataagagatgtaaataaagaaaaagtagtaggtcgagtaattagtagtacaccactagcagaaaacacaaatagcgtaacaaatatcgaattggaaccaccatttggagatagttatatagtaataggagtaggaaatagcgcactaacactacattggtttagaaaa

SEQ ID NO: 2253 - RNA, 1272 nt, synthetic construct
  misc_feature 1..1272: note = derived and/or modified CDS sequence (opt6) from DENV-4 Consensus__EdelTM-variant (aa1-424)
  source 1..1272: mol_type = other RNA
atgagatgcgtaggagtcggaaatagggactttgtagaaggagtatcaggaggagcatgggtagatttagtattagaacatggcggttgtgtaacaacaatggcacaaggaaaaccaacattagatttcgaattaacaaagacaactgctaaagaagtagctttactaagaacatattgtatagaagcgtcaataagtaatataactacagcgactagatgtccgacacaaggagaaccatatttaaaagaggaacaagatcaacaatatatatgtagaagagatgtagtagatagaggatggggaaacggatgtggattattcggaaaaggaggagtggtcacatgtgcaaaatttagctgcagtggaaaaataactggaaatttagtgcaaatagaaaatttagaatacacagtggtagtaacagttcataatggagacacacatgcagtcggaaacgacacaagcaatcatggagtaacagcgacaataacaccaagaagtccgagcgtagaagtaaaattaccagattatggggaactaacactagattgtgaaccaagatcgggaatagattttaatgaaatgatattaatgaaaatgaaaaagaaaacatggttagttcataaacaatggtttctagacttaccattaccatggacagctggagcagatacaagtgaagtacattggaactataaagaaagaatggttacattcaaagtaccgcatgcaaaaagacaagacgtaacagtattagggagtcaagaaggagcaatgcatagtgcattagcgggtgcaacagaagtagatagcggagacggaaatcatatgtttgcaggacatttaaaatgtaaagtacgaatggaaaaattaagaataaaagggatgagttatacgatgtgttcgggaaaatttagcattgataaagaaatggcagaaacacaacatggaacaacagtagtaaaagtaaaatatgagggagcaggagctccctgtaaagtaccaatagaaataagagatgtaaataaagagaaagtagtaggaagagtaataagttcaaccccattggcagaaaatacaaatagtgtaactaatatagaattagaaccaccttttggagacagttatatagttataggagtaggaaattcagcgttaacattacattggttcagaaaaggtagttcaataggaaaaatgtttgaaagtacgtataggggagcaaaaagaatggcaatattgggggaaacagcgtgggactttggaagt

SEQ ID NO: 2254 - RNA, 1266 nt, synthetic construct
  misc_feature 1..1266: note = derived and/or modified CDS sequence (opt6) from DENV-4 Consensus__EdelTM-variant (aa1-421)
  source 1..1266: mol_type = other RNA
atgagatgtgtaggagtaggaaatagagattttgtagaaggagtaagtggaggagcatgggtagacctagtactagaacatggaggatgtgtaacaacaatggctcaaggaaaaccaacgttagattttgaattaactaaaacaacagcaaaagaagtagcactattaagaacttactgcatagaagcatcaataagcaatataactacagcaacaagatgtccaacacaaggagaaccatatttaaaggaagaacaagatcaacaatatatatgcagaagagatgtagtagacagaggttggggaaacggatgtggattgttcggaaaaggaggagtagttacatgtgcaaaatttagttgtagcggcaaaattacaggaaatttagtacaaatagaaaatctagagtatacagtagtagtaacagtacataatggagatacacatgcagtaggaaatgatacaagtaatcatggagtcacggctacaataacgccaagaagcccaagtgtagaggtaaaactaccagattacggagaattaacattagattgtgaacctagaagtggaattgattttaatgaaatgatattgatgaaaatgaaaaagaaaacatggttagttcataaacaatggtttttagatcttcctctaccatggacagcaggagcagatacatcagaagttcattggaactataaagagaggatggtaacattcaaagtaccacatgccaaaagacaagatgtaacagtactaggtagtcaagaaggagcaatgcatagtgcattagcaggggcaacagaagtagatagtggagatggaaatcatatgtttgcaggacatctaaaatgcaaagttcgaatggaaaaactaagaataaaaggaatgagctatacaatgtgcagtggcaaattttcaatagacaaagaaatggcagaaacacaacatggaacaacagtcgtaaaagtaaaatacgaaggcgcaggagcaccttgtaaagtcccaatagaaataagagacgtaaataaagaaaaagttgtaggaagagtaataagtagcacaccattagcagaaaacacaaatagtgtaacaaatatagaactagaacccccattcggagatagttatatagtaattggagtaggaaattcagctctaacattacattggttcagaaaaggtagtagcataggaaaaatgtttgaaagtacgtacagaggggcaaaaaggatggcaatattaggagaaacagcatgggattaa

SEQ ID NO: 2255 - RNA, 2031 nt, synthetic construct
  misc_feature 1..2031: note = derived and/or modified CDS sequence (opt6) from DENV-4 Consensus__SSc-prME
  source 1..2031: mol_type = other RNA
atgtcaacaattactttactatgccttataccaaccgttatggcatttcatctaagcactagagatggtgaaccattaatgatagtagcaaaacatgaaagaggaagaccattactatttaaaactacagaaggaataaacaaatgtacattaatagcaatggatctgggagaaatgtgcgaagatactgtaacttataaatgtccattacttgttaatacagaaccagaagacatagattgttggtgtaatctaacaagcacatgggtcatgtatgggacttgcactcaaagtggagaaagaagaagagagaaaagaagtgtagccttaacaccacacagcggaatgggattagaaacaagagcagaaacgtggatgagtagtgaaggggcttggaaacacgcacaaagagtagaaagttggatactaaggaaccctgggtttgctttactagcaggatttatggcatatatgataggccaaacagggatacaaagaactgtattcttcgtactaatgatgttagtagcacctagttatggaatgcgttgtgtaggagtgggaaacagagacttcgtagaaggagtaagtgggggagcatgggtagatttagtattggaacatggtggatgcgtaacaacaatggcacaaggaaaacctactttagacttcgaactcacgaaaacaacagcaaaagaagttgcactactaagaacatattgtatagaagcaagtatatcaaacataacaaccgctacgagatgtccaactcaaggtgaaccatatcttaaagaagaacaagatcaacagtatatatgcagacgcgatgtagtagacagaggatgggggaatggatgtggattatttggaaaaggaggagtagtaacatgtgcgaaatttagttgtagtggaaaaataactggtaatcttgtacaaatagaaaatttagaatacacagtggtagtgacagtgcataatggagatacgcatgcagtaggaaatgatacaagtaatcatggagtaactgctacaataacaccaagaagtccatcagtcgaagtgaaacttccagattatggagaactgactctagactgtgaacctagatcaggaatcgatttcaacgaaatgatattaatgaaaatgaaaaagaaaacatggcttgtccataaacaatggttcttagatttaccactaccatggactgcgggtgcagatacatctgaagtacactggaactacaaagaaaggatggtaacttttaaagttccgcatgcaaaaagacaggatgtgacagtattaggatcacaagaaggagcaatgcacagtgcattagcaggagcaacagaagtagactcaggtgatggaaatcatatgtttgcaggccatttaaaatgtaaagtaagaatggaaaaattaagaatcaaaggaatgtcctatacaatgtgcagtgggaagttttctatcgataaagaaatggcagaaacgcaacatggaacaactgtagttaaagttaaatatgaaggagcaggagcaccttgtaaagtaccaatagaaataagagacgtgaataaagaaaaagtagtaggaagagttataagttcaacacctctagctgaaaatactaatagtgttacaaatatagagctagaaccgccatttggagacagttatattgtaataggagtaggaaattcagcactaactctacattggtttaggaaaggaagcagtattggtaaaatgtttgaaagcacttacagaggagctaaaagaatggcaatactaggggaaacagcatgggactttggatcagtcggaggattatttacaagtctaggaaaagcagtacaccaagtctttggcagcgtatacacgaccatgttcggaggagtaagctggatgataagaattttaatagggtttctagtactgtggattgggacaaattcaagaaacacaagcatggcaatgacatgcatagctgtaggtggcattacattatttttaggttttacagtacaagcgtaa

SEQ ID NO: 2256 - RNA, 2031 nt, synthetic construct
  misc_feature 1..2031: note = derived and/or modified CDS sequence (opt6) from DENV-4 Consensus__SSc-prME(F108S)
  source 1..2031: mol_type = other RNA
atgagtacaataacactactgtgcctgataccaacagtaatggcatttcacttatcaacaagagacggagaaccattaatgatagtagcaaaacatgaaagagggagaccattattatttaaaactacagaaggtataaataaatgtaccttaatagcaatggacttaggagaaatgtgcgaagatacagtgacatacaaatgcccactattagttaacacagaaccagaagacatagattgttggtgtaatctaacaagtacatgggtaatgtatggtacatgcactcaatcaggagaaagaaggcgcgagaaaagaagcgtagcactaacaccacacagtggaatgggattagaaacaagagcagagacttggatgagtagcgaaggagcctggaaacatgcacaaagagtagaatcatggatactacgaaatccaggatttgcattactagccggattcatggcatatatgattggacaaacaggaatacaaagaactgtcttcttcgtactaatgatgttagtcgcaccatcgtacggaatgagatgtgtaggagtaggcaatagagattttgttgaaggagtaagtggaggagcatgggttgatttggtgttagaacatggaggatgcgtaacaaccatggcacaaggaaaaccgacattagatttcgagctaacaaaaacaacagcaaaggaagtagcattattaagaacatattgcatagaagcatcaatatctaatataacaacagctacaagatgtccaacacaaggcgaaccatatctaaaagaagaacaagaccagcagtacatatgccgacgtgacgtagtagacagagggtggggaaatggatgcggactatcagggaaaggaggcgtagtcacttgtgcaaaattctcatgtagtggaaaaataacaggtaacttagttcaaattgaaaacctggaatatacagttgtagtcacagtacataacggagatacacatgcagtcggaaatgacacaagtaatcatggtgttactgcaaccattacaccaagaagtccaagcgtagaagtaaagttacctgattatggagaactaacattggattgtgaacccagatcaggaatagactttaatgaaatgatattaatgaaaatgaaaaagaaaacatggttggtacataaacagtggtttttagatttgccactaccatggacagcaggagcagatacatcagaagtacattggaattataaagaaagaatggtcacgtttaaagttcctcatgctaaaagacaagacgtaacagtattaggatcacaagaaggagcaatgcatagtgcattagctggagcaacagaagtagatagtggagatggaaatcatatgtttgcaggacatttaaaatgtaaagtaaggatggaaaaattaagaataaagggtatgagttacacaatgtgttcaggaaaattctcaatcgataaagaaatggcagaaacacaacatggcacaacagtagtaaaagtaaaatacgagggggccggtgcaccctgtaaagttccaatagaaataagagacgtaaataaagaaaaagtagtaggtagagtaataagtagcacaccattggcagagaacacaaattcagtgactaacatagaactggaaccaccttttggagatagttacatagtaataggagttggaaactcagctttaacattacattggttcagaaaaggatcatcgataggaaaaatgtttgaaagtacttatagaggcgccaaacgaatggcaatattaggagaaacggcttgggattttggaagtgtcggaggtttattcacatctctaggaaaagcagtacatcaagtatttgggagtgtatatacaacaatgttcggaggggttagctggatgataagaatattaataggatttttagtattatggataggaacgaactcaagaaatacatccatggctatgacatgtatagctgtaggaggaattacactatttctcggcttcacagtacaagcctaa

SEQ ID NO: 2257 - RNA, 2031 nt, synthetic construct
  misc_feature 1..2031: note = derived and/or modified CDS sequence (opt6) from DENV-4 Consensus__SSc-prMEdelstem_TM-JEV
  source 1..2031: mol_type = other RNA
atgagtacaataacattgttatgcctaataccaacagtaatggcattccatttaagcacaagagatggtgaaccacttatgattgtagcaaagcatgaaagaggaagacctttgctatttaaaacaacagaaggtataaacaaatgtacattaattgcaatggatttaggggaaatgtgcgaagataccgtaacatataagtgtccactactcgtaaatacggaacctgaagatatagactgttggtgtaatctcacttcaacttgggttatgtatggtacatgtacacaatctggtgaaagaagaagagagaaaagaagtgtagctttaacgccacattcagggatgggattagaaactagagcagaaacatggatgagcagtgaaggagcatggaaacacgcacaaagagtagaaagctggattttaagaaatccaggattcgcattgttggcaggatttatggcatacatgattggacaaacaggaatacaaagaacagtattctttgtcttgatgatgttagtagctccttcatatggaatgcgttgtgtaggagtgggtaatcgagattttgtagaaggagtaagcggaggagcatgggtagacttagtattagaacatggaggatgtgttacaacaatggcacaaggaaaaccaacattagactttgaactcacaaaaacaacagcaaaagaagtagcactattaaggacctattgcatagaagcgagcatatcaaacataactacagcaactaggtgtcctacacagggggaaccataccttaaagaggaacaagaccaacaatacatttgcagacgagatgtagtcgatcggggatggggcaatggttgtggactatttggaaaaggaggagtggtaacttgcgctaaatttagttgtagtggaaaaataacaggaaacctagtacaaattgaaaacttagaatatacagtagttgtaacagtacacaacggagatactcatgcagtaggaaatgacactagcaatcatggagtaacagcgacaataactcctagaagtcccagtgtagaagtaaaattaccagattatggagaattaacattagactgtgaaccaagaagtggaatagattttaatgaaatgatacttatgaaaatgaaaaagaaaacatggttagtacataaacagtggtttttagacttacctttaccatggacagcaggagcagatacaagtgaagttcattggaactataaagaacgaatggttacttttaaagtgccacatgcgaaaagacaagatgttactgtattaggatcacaagagggcgcaatgcatagtgctctagcaggagcaacagaagttgatagtggagatgggaatcatatgtttgcaggacacttaaaatgtaaagtaaggatggaaaagttacggataaaaggaatgagctatacaatgtgtagtggaaaattttcaatagataaagaaatggcagaaacccaacatggaacaacagtagttaaagtaaagtatgaaggagctggtgccccatgtaaggtgccaatagaaattagagacgtaaataaagagaaagtagtaggaagagtgataagtagcacaccgttagctgaaaatacgaatagcgttacaaatatagagttagaaccaccttttggcgatagctatatagtaataggagtaggaaatagtgcactgactttacactggtttagaaagggctcaaccttaggaaaagcgtttagcactacattaaaaggggcacaaagattagcagctctaggagatactgcttgggattttggttcaattggaggcgtatttaattcaattggtcgtgcggtacatcaagtatttgggggagcattcagaacactattcggaggaatgtcatggataacacaaggattaatgggcgcacttctactatggatgggggttaatgctagagacagatctatagcgttagcttttcttgcaacgggaggtgtcctagtttttcttgctactaatgtacacgcttaa

SEQ ID NO: 2258 - RNA, 1332 nt, synthetic construct
  misc_feature 1..1332: note = derived and/or modified CDS sequence (opt6) from DENV-4 Consensus__SSm-EdelTM
  source 1..1332: mol_type = other RNA
atgatacaaagaacagtattctttgtattaatgatgttagtagcaccaagctatggtatgagatgtgtaggagtaggaaatagagattttgtagaaggagtgagtggaggggcatgggtagacttagtactagaacatggaggatgtgttactacaatggctcaaggaaaaccaaccctagattttgaactaaccaaaacaacagcaaaagaagttgcattattaagaacatactgcatagaagcgagcataagtaatataacaacagcgacaagatgcccaactcaaggagaaccatatctaaaagaagaacaagatcaacaatatatatgtcgaagagatgtagttgatagaggatggggaaacggttgtggattattcggaaaaggaggcgtagtaacatgcgcaaaatttagttgtagcggaaaaataacaggaaatctagttcaaatagaaaatttagaatatacagtagttgtaacagtacacaatggagatactcatgcagtaggaaatgacacaagtaatcacggagtcactgccacaataacaccaagaagtcctagtgtggaagtaaaattaccagattacggagaattaacgctagactgtgaaccacgaagcggaatagattttaacgaaatgatacttatgaaaatgaaaaagaaaacatggctagttcacaaacaatggttcctagatttaccattgccatggacagcaggagcagatacgagcgaagtacactggaattataaagaacgaatggtaacattcaaagtaccacacgctaaaagacaagacgtaacggtattaggatcacaagaaggagcaatgcattcagcattagcgggagcaacagaagtagatagcggagatggaaaccacatgtttgcaggacatttaaaatgtaaagtcagaatggaaaaattaagaataaaaggaatgagttacacaatgtgcagtggaaaattctcaatagataaagaaatggcagaaacacaacatggtacaacagtggtaaaagtaaaatatgaaggagcaggagcaccatgtaaagtacctatagaaatacgtgatgttaacaaagaaaaagtagtaggaagagtaatatcatcaacaccactagcagaaaatacgaacagtgtaacaaatattgaattggaaccacctttcggagactcatatatagtaataggagtaggaaactcagcactaactttacattggtttagaaaaggatcaagtataggaaaaatgttcgaatcaacatacagaggagcaaaaagaatggcaatattaggggaaaccgcctgggattttggatcttaa

SEQ ID NO: 2259 - RNA, 2376 nt, synthetic construct
  misc_feature 1..2376: note = derived and/or modified CDS sequence (opt6) from DENV-4 Consensus__C-P2A-SSc-prME
  source 1..2376: mol_type = other RNA
atgaaccaaagaaagaaagtcgtaagaccaccatttaacatgttaaaaagagaacgaaatagggttagtacaccacaagggttagtgaaaagattcagtactggtttatttagtggaaaaggaccgctacgaatggtactagcatttattacctttctaagagtattgtcaatcccaccaacagcaggcatcttgaaacgatggggacaacttaagaaaaacaaagctataaaaatattaataggatttagaaaagaaataggtagaatgttaaatatactaaatggacgaaaacgaaacttcgatctactaaaattagcaggggatgtagaatcaaatcccggtcccagtacaataacgctgttatgtctaataccaacagtaatggcattccatttatctacaagagacggagaaccattaatgatagtagcaaaacatgaaagggggagacccctactatttaaaacaacagaaggaataaataaatgtactctgatagccatggacctaggagaaatgtgtgaagatactgtaacatacaaatgccctctattagtaaatacagaacctgaggatatagattgttggtgtaatttgacaagtacttgggtaatgtacggaacgtgtacacaatcgggtgaaaggagaagagagaaaagaagcgtcgccttaacaccacatagtggaatgggtctggaaacacgagccgaaacatggatgtctagtgaaggagcttggaaacatgctcaaagagttgaaagttggatactacgtaatcccggatttgctctattagcaggtttcatggcatatatgataggacaaacaggaatacaacgaacagtattctttgtactaatgatgttagtagcaccatcatatggaatgagatgcgtcggagttggaaatcgtgatttcgtagaaggtgtaagcggaggagcatgggttgacttagtcttagaacatggaggttgcgtaacaactatggcacaaggtaaaccaactctagattttgaattaacaaaaacaacagcaaaagaagttgcattgttaagaacatactgtatagaagcctctatatctaacattactacggcaacaagatgccctacacaaggtgagccttatttaaaagaggaacaagatcaacaatatatatgtagaagagacgtagtagatcgaggttggggaaatggttgtggcttatttgggaaaggaggagtagttacatgtgcaaagttctcgtgttctggtaagataacaggaaacctagtccaaatagaaaatttagaatatacagttgtggtaacagtacacaacggagacactcatgcagtcggtaatgacacctcaaaccatggtgtaacagcaacaattacacccagaagtccgagtgtagaagttaaactgccggattatggagaattaactttagactgtgaacccagaagcggaatagattttaatgaaatgatattaatgaagatgaaaaagaaaacatggctcgtacataaacaatggtttttggatctaccgcttccgtggacagcaggcgcagatacatcagaagtacattggaattacaaagaaagaatggttacattcaaagtaccacatgcaaagcgacaagacgtgacagtactcggtagccaagaaggagccatgcatagcgcgttagcaggagcaacagaagtagattcaggtgacggaaatcacatgtttgcaggtcatctaaaatgcaaagtaaggatggaaaaactaagaataaaaggaatgagctatacaatgtgttcaggaaaattttcaatcgacaaagaaatggcagaaacccaacacggtacaacagttgttaaagtaaaatacgaaggggctggtgcaccttgtaaagttccaatagaaataagagatgttaataaagaaaaagtagttggaagggtaatatctagcacaccactggcagaaaatacaaacagtgtaacaaatattgaactagaacctccctttggagatagttatatagttataggcgtaggtaatagcgccctaacactacattggtttagaaaaggtagcagcataggtaaaatgtttgaatcaacatatagaggagctaaacgaatggcaatacttggagaaactgcatgggattttggttcagtaggcggattatttacaagtttgggtaaagccgtacatcaagtattcgggtcggtatatactactatgtttggaggcgtcagttggatgataagaattttaatcggatttttagtactgtggataggtacaaattcaagaaacacgagcatggcaatgacatgtatagcagtaggtgggataacattatttttaggcttcacagtacaggcataa

SEQ ID NO: 2260 - RNA, 2043 nt, synthetic construct
  misc_feature 1..2043: note = derived and/or modified CDS sequence (opt6) from DENV-4 Consensus__SSopt-prME(F108S)
  source 1..2043: mol_type = other RNA
atgaaaagaaagaaaagcacaataacactattatgcttgataccaacagtaatggctttccatttaagcacacgtgatggagaaccactaatgatagtagccaaacatgaaaggggtaggcctttgctttttaaaacaactgaaggtataaataagtgcacgctaatagcaatggatctaggagagatgtgtgaagatacagttacatacaaatgccctttgttagttaatacggaaccagaagatatagactgctggtgtaacttaacgagtacatgggtaatgtatggaacatgcacccagagtggggaaagaagaagagagaaaagaagtgtagcattaacaccacattcagggatgggattagaaaccagagcagaaacatggatgagtagcgaaggagcatggaaacacgcacaacgagtagaaagctggatattaagaaacccaggctttgcactcttagcgggtttcatggcatacatgataggccaaacaggaatacaaaggactgtatttttcgttctaatgatgcttgtagcacctagttatgggatgagatgcgttggagtcggcaatagagatttcgtagaaggagtaagtggtggagcatgggtagatttagtattagaacatggaggttgcgtaaccacaatggcgcaaggaaaaccaacattagattttgaattaacgaaaacaactgcaaaagaagtggcactattaagaacatattgcatagaggctagtataagtaatattacaacagcaacaagatgccctacacagggagagccttatttaaaagaagaacaagaccaacagtatatatgcagaagagatgtagtagacagaggatggggaaatgggtgtggattaagtggaaaaggaggggtagtgacatgtgcaaaattttcttgtagtggtaaaataacaggaaatctagttcagatagaaaatttggaatatacagtagtagtgacagtacataatggggatacacatgcggtaggtaatgacacatcaaatcacggagtaacagccacgattacaccaagaagtcctagtgttgaagtaaagttacctgattatggagaattaactttagactgtgaaccgaggagcggaatagattttaatgaaatgattttaatgaaaatgaaaaagaaaacatggctggtacacaaacaatggttcctagatttaccactaccatggacagccggagcagatacaagtgaagtacactggaattataaagagcgaatggtaacttttaaagtaccacatgcaaagagacaggatgttacagtcctaggaagtcaagaaggagcaatgcattcagcattagcaggagcgacagaagtagatagcggggatggaaatcatatgttcgcagggcatttaaaatgtaaagtaagaatggaaaaacttcgaataaaaggtatgagttacactatgtgtagcggaaagttttctatagacaaagaaatggcagaaacgcaacatggaacaaccgtggtaaaagtaaaatacgaaggagcgggagcaccatgtaaagtaccaatagaaatacgagatgtaaataaagaaaaagtagttggcagagtaattagtagtacacccttggccgaaaatacaaacagcgtaacgaacatagaactagaaccgccgtttggagatagctacatagtaataggagtaggaaattctgctttaacattacattggtttagaaaaggtagtagtattggaaaaatgttcgaatcaacgtatagaggagcaaaaagaatggcaatattaggagaaacagcatgggactttggaagtgtaggaggtttattcaccagtttagggaaagcagtacatcaagtatttgggagtgtgtatactacaatgtttgggggagtaagctggatgataaggatattaataggatttttagtattatggataggaactaatagcagaaatacatcaatggcaatgacatgtattgcagtcggaggaataacattatttcttggatttacggtacaagcataa

SEQ ID NO: 2261 - RNA, 2043 nt, synthetic construct
  misc_feature 1..2043: note = derived and/or modified CDS sequence (opt6) from DENV-4 Consensus__SSopt-prME(V96H)
  source 1..2043: mol_type = other RNA
atgaaaagaaagaaaagtacaataacactattatgtctaataccaacagtaatggcatttcacttaagtacaagagacggagaaccattaatgatcgtagctaaacatgaacgaggaagacctttactattcaaaacgacagaaggaattaataaatgcacacttatagcaatggatttaggagaaatgtgtgaagacacagtaacatataaatgcccattgttagtcaacacagaaccagaagatatcgactgttggtgtaatttaacaagcacgtgggtaatgtatggaacatgtactcaatcaggtgagagaaggagagaaaaacgaagtgttgcattaacaccacattccggaatgggtctagaaacacgagccgaaacgtggatgagttcagaaggagcgtggaaacatgcgcaaagggtggaatcatggatactaaggaatcctggttttgcactactagcgggctttatggcctatatgataggacaaacagggattcaaaggacagttttctttgtactaatgatgttagtagctccatcatatggaatgcgatgtgtaggagtcggaaatagagattttgtagaaggagtatcgggtggagcatgggttgatttggtattagaacacggcggatgtgtaacaaccatggctcaaggcaaacccacattagactttgaattaactaaaacaactgcaaaagaagttgcgctattaaggacatattgtatagaagcaagcatatccaatataacaactgcaactaggtgcccaacacaaggtgaaccatatttaaaagaagaacaagatcaacaatacatatgtaggcgagatcatgttgatagaggttggggaaatggttgtggactatttggaaaaggaggtgttgtaacatgtgcaaaattttcatgcagtggaaaaatcacagggaacctagtacagatagaaaatctagaatatacagtggttgtaacagtacataatggtgatacacatgccgtaggaaatgatacaagcaatcatggagtaacagcaacaattactccaagatctccatcagtcgaagtgaaattaccagattatggggagttgaccttagattgcgaaccaaggagcgggatagattttaatgaaatgatactaatgaaaatgaaaaagaaaacttggctagttcacaaacaatggtttctagacttacctttaccatggacagctggggcagatacgtcagaagtacattggaactataaagaaagaatggtaacattcaaagtaccacatgcaaaaagacaggatgtaacagtgctaggatcacaagaaggagcaatgcatagtgcattggccggtgcaactgaagtagacagtggagatggtaatcatatgtttgcaggacatttaaaatgtaaagtgagaatggaaaaacttagaattaaaggaatgagttataccatgtgctcaggcaaattctcaattgataaagaaatggcagaaacacaacatggaacaacagtagtaaaagtcaaatatgaaggtgctggagcaccatgtaaagtaccaattgaaattagagatgttaataaagaaaaagttgtcggaagagtaataagtagtacacctttagcagaaaatactaacagtgtaacaaatattgaacttgaaccgccttttggagacagctacatagttataggtgtaggaaatagtgccctaactttacactggtttagaaaaggatcgagcataggaaaaatgtttgaaagtacatatagaggtgctaaaagaatggcaattttaggtgaaacagcttgggactttggatcagtaggtggattatttacaagtctagggaaagcagtacaccaggtttttggtagtgtatatacaactatgtttggaggggtaagttggatgataaggattttaataggctttttagtattatggattggaacaaattctagaaataccagtatggctatgacttgtatagcagttggtggaataacattattcttaggattcaccgtacaagcataa

SEQ ID NO: 2262 - RNA, 2043 nt, synthetic construct
  misc_feature 1..2043: note = derived and/or modified CDS sequence (opt6) from DENV-4 Consensus__SSopt-prME(E186F)
  source 1..2043: mol_type = other RNA
atgaaaaggaagaaatcaactataacattattatgccttattccgacagtaatggcatttcatctgtcaacaagagatggcgagccgttaatgattgtagcaaaacatgaaagaggaagaccattgttatttaaaacgaccgagggaattaataaatgcacattaattgcaatggacctgggcgaaatgtgtgaagatacagttacttataaatgtccattattagttaatacggaaccagaagatatagactgttggtgtaatctaacatcaacttgggtaatgtatggcacatgtacacaatcaggagaaagaagaagagagaaaaggagtgtggcgttaacaccacattcaggaatgggattggaaacaagagcagaaacttggatgagttctgaaggcgcctggaaacacgcacaaagagtggaaagttggatattgagaaacccaggtttcgcattattagcaggattcatggcgtacatgataggacaaacagggatacaaagaacagtatttttcgttttaatgatgctagttgcaccatcatatggcatgagatgtgtaggagtaggaaatagagattttgtagaaggagtaagcggaggagcatgggtagacttagtactagaacacggagggtgtgtgactactatggcacaagggaaacctacactagattttgaattaactaaaacaacagcaaaagaagtagcactactaaggacctattgcatagaagcaagcataagtaacataacaacagccacgagatgcccaacccaaggtgaaccatacttaaaagaagaacaagaccaacagtacatatgtagaagagatgttgtagacagaggatggggaaatggctgtggattatttggcaaagggggtgtagtaacatgtgcaaaatttagttgtagtggaaaaattacaggcaatttagtccaaatagaaaacttagaatatacagtagtagtaaccgttcacaatggcgacacacatgcagtaggtaacgatacgagtaatcatggagttacagctacgataacaccaagaagtccatcagtagaagtaaaattacccgattatggagaactaacattagattgtttccctcgaagcggtatagattttaatgagatgatactcatgaaaatgaaaaagaaaacttggttagtacacaaacaatggtttctagacttaccattaccttggacagcaggagctgacacaagtgaagtacattggaattataaagaaagaatggtaacatttaaagttccacatgcaaaaagacaagatgttacggtattaggatcacaagaaggagcaatgcatagtgcactagctggtgcaactgaggtagatagcggggatggaaatcacatgtttgcaggtcatctaaaatgtaaagtaagaatggaaaaattaagaataaaaggtatgagttacacaatgtgctcaggaaaattttctatagacaaagaaatggcagagacacaacatgggacgacggtagtaaaagtaaaatatgaaggagccggagcgccgtgtaaagtacccattgaaataagagatgttaataaagagaaagtagtaggaagggtaatatcgtcaacgccattagcagaaaatacaaatagtgtaacaaatatagaactagaacctccattcggagatagttatatagttataggagtagggaatagtgcgctaacgttacattggtttagaaaaggaagctcaataggcaaaatgttcgagagcacatatcgaggagcaaaaagaatggcaatattaggggaaacagcatgggatttcggatctgtagggggacttttcacttcattaggaaaagcagtacatcaagtatttggatccgtatataccacaatgtttggaggtgtttcttggatgataagaattttaataggttttctagtactatggataggaactaatagtagaaatacaagcatggcaatgacttgtatagcagtaggaggaataacactatttttaggatttacagttcaagcataa

SEQ ID NO: 2263 - RNA, 2043 nt, synthetic construct
  misc_feature 1..2043: note = derived and/or modified CDS sequence (opt6) from DENV-4 Consensus__SSopt-prME(R188L)
  source 1..2043: mol_type = other RNA
atgaaaagaaagaaatcaacgatcacattattatgtctcataccaacagtaatggcattccacctaagcactagagatggagaaccgctaatgattgtagcaaaacatgaaagagggagacctttactatttaaaacaacagaaggaataaataaatgcactctaatcgccatggacttaggagaaatgtgtgaagacacagtcacttataaatgcccactattagtaaatactgaaccagaagatatagactgttggtgtaatttaacaagtacatgggtgatgtatggtacttgtacacagagtggagaaagaagaagagaaaagagaagtgtagcattaactccccattctggaatgggtctggaaacaagagcagaaacgtggatgagttcagaaggagcatggaaacacgcgcaacgagtagaaagctggatactcaggaatcctggatttgcactactggcgggttttatggcttatatgataggacaaacaggaatccagagaacagttttctttgtattaatgatgctagtagctccaagttatggaatgcgatgcgtaggagtagggaatagagactttgtagaaggagtatcaggaggtgcatgggttgaccttgtattagaacatggaggttgtgtgacaaccatggcacaaggaaaaccaacactagattttgaattaacaaaaacaactgcaaaagaagtagcgttattaagaacatactgtatagaagcgagtataagcaacataacaacagctacaaggtgcccaactcaaggggaaccatatctaaaagaagaacaggatcaacagtacatatgcagaagagatgttgtagatagaggatggggaaatggatgtggcctatttggtaaaggaggagtagtaacatgcgcaaaatttagctgtagtggaaaaataacaggaaacctagtacagatagaaaatttagaatatactgtggtagtaacagtgcacaatggagatactcacgccgtaggtaatgacacatcaaatcatggagttactgctactataacaccgagatcaccatcagtagaagtaaaattgccagattacggtgaattaacactagattgtgaaccattaagtggaatagatttcaatgaaatgatactaatgaaaatgaaaaagaaaacatggttagtgcataaacagtggtttcttgatttaccgttaccgtggacagcaggagcagacacaagcgaagtacattggaattataaagaaagaatggttacatttaaagtaccacacgctaaaagacaagatgttactgtacttggatcacaagaaggtgcaatgcacagtgcactagcaggagcgacagaagtagattctggggacggaaatcacatgtttgcaggacatttgaaatgtaaagtgcgaatggaaaaactaagaataaaaggaatgtcatacacaatgtgtagtggtaaattcagtatcgataaggaaatggcagaaacacaacatggaacaacagtagtaaaagtaaaatatgaaggagccggtgcaccatgtaaagtaccgatagaaataagagatgtcaacaaagaaaaagtagtcggacgagtgatttctagcacacctttagcggaaaatacaaactcagtaacgaatatagaactagaacctcccttcggagatagttatatcgtaataggagtaggaaattcagcattaacattacattggtttagaaaaggaagctcaataggtaaaatgtttgaaagtacgtatagaggagcaaaaagaatggcaattttaggagaaactgcatgggatttcgggtcagtaggaggattgtttacatcactaggaaaagcagtacatcaagttttcggaagcgtatataccaccatgtttggaggagttagctggatgataagaatacttataggatttctagttctatggataggaacaaatagtagaaacacatcaatggcaatgacatgtattgcagtagggggtattacattatttttaggttttacagtacaagcctaa

SEQ ID NO: 2264 - RNA, 2043 nt, synthetic construct
  misc_feature 1..2043: note = derived and/or modified CDS sequence (opt6) from DENV-4 Consensus__SSopt-pr(D104A)MEdelstem_TM,(F108S)-JEV
  source 1..2043: mol_type = other RNA
atgaaaaggaaaaagagtacaataactttattatgcctaataccaacagttatggcatttcatctaagcacaagagacggagaacctttaatgattgtagccaaacacgaaagaggaagaccactattatttaaaacaacagaaggaattaataaatgtacactaatagcaatggatttaggagaaatgtgtgaagacacagttacttataaatgcccactattagtgaatacagagccagaagatatagattgttggtgcaatttaacgagtacatgggttatgtatggtacatgcacacaaagtggagaaagaagaagggcaaaacgatctgtagcattaacacctcactccggaatgggactagaaacaagagcagagacatggatgagtagcgaaggagcatggaaacatgcacaaagagtagaaagctggatattaaggaacccaggttttgcattgttagctggatttatggcgtatatgatcggacaaacaggaatacagagaacagtattctttgtcttaatgatgttagtggcacccagttacggaatgcgatgtgtaggggtgggtaatagagatttcgtagaaggcgtgtcaggaggcgcctgggtagatttagtactagaacacggaggctgtgttacaactatggcacaaggtaaaccaacactagatttcgaactaactaaaacaacagcaaaagaagtagcattattaagaacatattgtatagaagcaagtatatcgaatataacaacggcgacgagatgtccaacacaaggagaaccatatttaaaagaagaacaagatcaacaatatatatgtcgacgagatgtagtagatagaggatggggaaacggatgtggactaagtgggaaaggaggagtagtaacatgcgcaaaattctcctgtagtggaaaaataacaggaaatttagttcaaatagaaaatttggaatatacagtggtagtaacagtacataacggtgatacacatgcagtaggaaacgatacttcaaatcatggagtaacagcaacaataactccaagaagtccgagtgtagaggtcaaattacctgattacggagagctaaccttagactgtgaaccccgatcaggaattgattttaatgaaatgatattaatgaaaatgaaaaagaaaacatggctagtacataaacagtggtttttagacttaccactaccatggactgcaggggcagatacatcagaagtacattggaactataaagaacgaatggtaacttttaaagtcccacatgcaaaacgacaagatgtcaccgtactcggatcacaggaaggagcaatgcactctgcattagcaggagcaactgaagtagatagtggagacggaaatcatatgtttgcaggacatctaaaatgtaaagtcagaatggaaaaactaagaataaaaggcatgtcatatacaatgtgtagcggaaaatttagtatagacaaagaaatggcagaaacacaacacggaactacagtagtaaaagtaaaatatgaaggtgctggcgctccatgtaaagttcctatcgaaataagagatgttaataaagaaaaagtagtagggcgagtaatttcatcaacgccattggcggaaaatacaaacagtgtaacaaatatagagctagagccaccatttggagacagttatatagtcataggggtaggaaatagtgctttaacacttcattggtttcgaaaaggatcaacattaggaaaagcgttttcaacaactctgaaaggagcgcaaagactagcagctttaggtgacactgcatgggactttggaagtattggtggagtttttaattcaataggtagagcagtacatcaagtatttggaggagcatttagaacattgtttggtggaatgagttggataactcagggcttaatgggagcactattattatggatgggcgtaaatgctagagacagatctattgcattagcatttttagcaactggaggagtattagtgttcttagcaacgaacgtacatgcatga

SEQ ID NO: 2265 - RNA, 2043 nt, synthetic construct
  misc_feature 1..2043: note = derived and/or modified CDS sequence (opt6) from DENV-4 Consensus__SSopt-prMEdelstem_TM,(H261N)-JEV
  source 1..2043: mol_type = other RNA
atgaaacgaaagaaaagtacaataacattgttatgtttaataccaaccgttatggcatttcacttatcaactagagatggtgaacctttaatgatagtagccaaacatgaaagaggaagaccattattatttaagacaacagaaggtataaacaaatgtactttaatagcaatggatctaggagaaatgtgtgaagacacagtaacatataaatgtccactacttgtgaatacggaaccagaggatatagactgttggtgtaatttaacatcaacatgggtaatgtacggaacatgtacacaaagtggagaaagacggagggagaaaagatcagtagcattaacaccacatagtggaatggggttagaaacacgagcagaaacatggatgagctcagaaggagcatggaaacatgcacagagagtagaatcatggatattgagaaatccaggcttcgcattgctagctggattcatggcatatatgataggacaaacgggaatacaacgtacagttttctttgttctaatgatgttagtagcaccgagttatggaatgagatgtgtaggagtcggaaatagggactttgtagaaggagtatcaggcggagcgtgggtagacttagtactagaacatggcggatgtgtaacgacaatggcacaaggtaaaccaacattagattttgaattaactaaaacaacagcaaaagaagtagcactattaagaacatactgcatagaagcatccataagtaatataacaaccgcaacacgatgcccaacacaaggtgaaccatatcttaaagaagaacaagaccaacagtatatttgcagaagagatgttgtagatagaggctggggaaatggatgtggattatttgggaaaggtggtgtagtcacatgtgccaaattttcatgcagtgggaaaattacagggaatttagtacaaatagaaaatctagaatacactgtagtagtaacggtgcacaatggagatacacatgcggtaggaaatgatacgtcaaatcatggagtaacagctacaataacaccaagaagtccatctgtagaagtaaaactacctgattatggagaattaacattagattgcgaacctagaagcggtatagattttaatgaaatgatattaatgaaaatgaaaaagaaaacatggttagtccataaacaatggtttctagatttaccattgccatggacagcaggcgcagatacaagtgaggttcattggaactataaagaaagaatggttacatttaaagtgccacatgcaaaaagacaagatgtaacagtcctaggctctcaagagggggctatgaatagtgctttagcaggggcgacagaagtagatagtggagatggaaatcacatgtttgcaggtcacttaaaatgtaaagtaagaatggaaaaactgagaattaaaggaatgagctatactatgtgtagtggtaaattttcaatagataaagaaatggcggaaacacaacatggaacaacagttgtaaaagtaaaatatgaaggagctggagcaccatgcaaagtacccattgaaataagagatgtaaacaaagaaaaagtggtagggagagtgataagtagcacgccgctagcagaaaatacaaattcagtcacaaacattgaattagaaccaccttttggagacagttatatagtaataggtgtaggaaatagtgcattaacgttacactggttcaggaaaggatctactttaggaaaagcattttcaacaacgctaaaaggagcacagcgattagcggcactaggagataccgcttgggatttcggcagcataggtggagtttttaatagtatcggtagagcggtacatcaagtttttggaggagcatttagaacactattcggaggaatgtcatggattacacaaggactcatgggcgctttgctattatggatgggagtaaatgcaagagatagatcaatagcattagcctttctcgcaaccggtggagtcttagtatttcttgctactaatgttcacgcataa

SEQ ID NO: 2266 - RNA, 2043 nt, synthetic construct
  misc_feature 1..2043: note = derived and/or modified CDS sequence (opt6) from DENV-4 Consensus__SSopt-prMEdelstem_TM,(R188L,A267T)-JEV
  source 1..2043: mol_type = other RNA
atgaaaaggaagaaaagcacaataacattattatgtctaataccgacagtaatggcatttcacttaagtacgcgagatggcgaaccactaatgatcgtggcaaaacacgaacgaggaagaccattattattcaaaactacagaaggaataaataaatgtacactaatcgctatggaccttggagaaatgtgtgaagatacagtaacgtataaatgtccattattagtgaatacagaaccagaagatattgattgttggtgtaatctaacatcaacatgggtaatgtatggaacatgtacccaaagcggagaacgaagaagagagaaaagatccgtagcactaacaccacatagcggtatgggactagaaactagggcagaaacatggatgtctagtgaaggcgcatggaaacacgcacaaagagtggagagttggattctaaggaatccaggtttcgctttattagcgggtttcatggcatatatgataggacaaactggaatacaaagaacagtatttttcgttttgatgatgctagtagcaccttcttatggaatgagatgcgtgggtgtaggaaacagagatttcgtggaaggagtaagtgggggagcatgggtagacctagtattagaacacggtggatgtgtaacaacaatggctcaaggaaaaccgacactagacttcgaattaaccaaaacaacagcaaaagaagtagcattgcttaggacctactgtatagaggcatcaataagtaacataacaacagcgacaagatgtccaacacaaggtgaaccatatctaaaagaagaacaagatcaacaatatatatgtcgtcgagacgtagtagaccgagggtggggaaatggatgtggattatttggaaaaggaggagtagtaacatgcgccaaatttagttgttcaggaaaaataacaggaaatttagttcaaatcgaaaatttagaatataccgtagtagtaactgttcataacggagatacacacgcagttggaaatgatacatcaaatcatggagttactgcaacaataactccaagaagtccatcagtagaagttaaactaccagattatggagaattaacattagattgcgaaccattaagtggtatagacttcaacgaaatgatattaatgaaaatgaaaaagaaaacatggttagtacataaacaatggtttttagatcttcctctaccatggacagcaggagcagatacaagtgaagtgcactggaactataaagaacgaatggtaacatttaaagtaccacatgcaaaaaggcaagacgtaacagtattgggtagccaagaaggagcaatgcacagcgcactcgcaggtacaacagaagtagattccggagatggcaatcatatgtttgcggggcacttaaaatgtaaagtaagaatggaaaaattaagaataaaaggcatgagttatacaatgtgcagtggcaaattcagtatagataaagaaatggcagaaacgcaacatggaacaactgtagttaaagtgaaatatgaaggagcaggagctccatgtaaagtaccaatcgaaataagagatgtaaataaagaaaaagtagtcggaagagtaataagtagtacaccattagcagaaaacactaactccgtgacaaatattgaattggaaccaccattcggagattcctatatagtaattggtgtaggcaatagtgcactgacactccactggtttcgaaaagggtcaacactaggaaaagcattttcaacaacattgaaaggagcacaaagattagcagcactaggggatacagcttgggacttcgggagcataggaggagtatttaattcaatagggagagcagtacatcaagttttcggtggagcattcagaacgttatttggaggaatgagttggataacgcaaggacttatgggagcgttattattatggatgggagtaaatgcccgagataggagtatagctttagcctttctagcgacaggaggagttctcgtatttttggcaacgaatgtacatgcataa

SEQ ID NO: 2267 - RNA, 300 nt, synthetic construct
  misc_feature 1..300: note = derived and/or modified CDS sequence (opt6) from DENV-3 Consensus__C
  source 1..300: mol_type = other RNA
atgaacaaccaaagaaaaaaaacaggaaaaccaagcataaacatgctaaaaagagtaagaaacagagtaagcacaggatcacaactagcaaaaagattcagcaaaggactactaaacggacaaggaccaatgaaactagtaatggcattcatagcattcctaagattcctagcaataccaccaacagcaggagtactagcaagatggggaacattcaaaaaatcaggagcaataaaagtactaaaaggattcaaaaaagaaatatcaaacatgctatcaataataaacaaaagaaaaaaa

SEQ ID NO: 2268 - RNA, 342 nt, synthetic construct
  misc_feature 1..342: note = derived and/or modified CDS sequence (opt6) from DENV-3 Consensus__C-SSc
  source 1..342: mol_type = other RNA
atgaacaaccaaagaaaaaaaacaggaaaaccaagcataaacatgctaaaaagagtaagaaacagagtaagcacaggatcacaactagcaaaaagattcagcaaaggattactaaacggacaaggaccaatgaaattagtaatggcattcatagcattcctaagattcctagcaataccaccaacagcaggagtactagcaagatggggaacattcaaaaaatcaggagcaataaaagtactaaaaggattcaaaaaagaaatatcaaacatgctatcaataataaacaaacgaaaaaaaacaagcctatgcctaatgatgatattaccagcagcactagca

SEQ ID NO: 2269 - RNA, 273 nt, synthetic construct
  misc_feature 1..273: note = derived and/or modified CDS sequence (opt6) from DENV-3 Consensus__pr
  source 1..273: mol_type = other RNA
tttcacttaacatcaagagatggagaaccaagaatgatagtaggaaaaaatgaaagaggaaaaagcttactatttaaaacagcatcaggaataaacatgtgcacactaatagcaatggacttaggagaaatgtgtgacgatacagtaacatataaatgtccacatataacagaagtagaaccagaagatatagactgctggtgcaatctaacaagcacatgggtaacatatggaacatgcaatcaagcaggagaacacagaagagataaaaga

SEQ ID NO: 2270 - RNA, 225 nt, synthetic construct
  misc_feature 1..225: note = derived and/or modified CDS sequence (opt6) from DENV-3 Consensus__M
  source 1..225: mol_type = other RNA
agcgtagcattagcaccacacgtaggaatgggattagacacaagaacacaaacatggatgagcgcagaaggagcatggagacaagtagaaaaagtagaaacatgggcactaagacacccaggatttacaatactagcactatttctagcacactatataggaacatcactaacacaaaaagtagtaatatttatattactaatgctagtaacaccaagcatgaca

SEQ ID NO: 2271 - RNA, 498 nt, synthetic construct
  misc_feature 1..498: note = derived and/or modified CDS sequence (opt6) from DENV-3 Consensus__prM
  source 1..498: mol_type = other RNA
tttcacttaacatcaagagatggagaaccaagaatgatagtaggaaaaaatgaaagaggaaaaagcttactatttaaaacagcctcaggaataaacatgtgcacattaatagcaatggacttaggagagatgtgtgacgatacagtaacatataaatgtccacatataacagaagtagaaccagaagatatagattgctggtgcaatctaacaagcacatgggtaacatatggaacatgcaatcaagcaggagaacacagaagagataaaagaagcgtagccttagcaccacacgtaggaatgggattagacacaagaacacaaacatggatgagcgcagaaggagcatggagacaagtagaaaaagtagaaacatgggcactaagacacccaggatttacaatactagcactatttttagcgcactatataggaacatcattaacacaaaaagtagtaatatttatattactaatgctagtaacaccaagcatgaca

SEQ ID NO: 2272 - RNA, 1479 nt, synthetic construct
  misc_feature 1..1479: note = derived and/or modified CDS sequence (opt6) from DENV-3 Consensus__E
  source 1..1479: mol_type = other RNA
atgagatgtgttggagtcggaaatagagattttgtagaaggattaagtggagcaacatgggtagatgtagtactagaacatggaggttgtgtgactacaatggcaaaaaacaaaccaactttagatatagaactacaaaaaaccgaagcaacacaactagcaacgctacgaaaattatgcatagaggggaaaataactaatataacaacagattcaagatgtccaacacaaggcgaagcaacactaccagaagagcaagaccaaaattatgtatgtaaacatacatatgttgacagaggatggggcaatggttgtggactatttggaaaagggagtctagtaacatgtgcaaaatttcaatgtttagaaccaatagaaggaaaagtagtacaatacgaaaatttgaaatacacagtaataataactgtacacactggagatcaacatcaagtaggaaatgaaacccaaggagtaacagcagaaataacgccacaagcaagtacaacagaagcaatattgcccgaatatggaacactaggactagaatgcagtccgaggacaggattagactttaacgaaatgatactattaacaatgaaaaataaagcatggatggtacatagacaatggttttttgatcttccactcccatggacttccggggcaacgacagaaactccaacatggaatagaaaagaattactagttacattcaaaaatgcacacgccaaaaaacaagaagttgtagtattaggaagtcaagagggtgctatgcatacagcacttacaggagcaacagaaatacaaaactcaggaggaacaagtatatttgctggacatttaaaatgtagattgaaaatggataaattagaactaaaaggtatgagctatgctatgtgtacaaatacatttgtactcaaaaaagaagtttcagaaacacaacacggaacaattttaataaaagttgaatataaaggtgaagatgtaccatgcaaaataccattcagtacagaagatggacagggaaaagctcataatggaagactaatcacagcaaacccagtagtaacgaaaaaagaagaacccgtaaacatagaagctgaacccccattcggagagagtaacatagtaataggaataggagataatgctttaaaaataaactggtataaaaaaggaagtagcattggaaaaatgtttgaagcaacagcaaggggagcaaggagaatggcaatcttaggagatactgcatgggactttggaagtgtaggtggagtactaaactcattaggaaaaatggtgcatcaaatatttggaagcgcatacacagctttattttcaggagtaagctgggtaatgaaaataggaataggagtactattaacctggattggattaaacagcaagaatacaagtatgagttttagttgtatagcaataggaataataaccttatatttaggggcagtagtacaagca

SEQ ID NO: 2273 - RNA, 1977 nt, synthetic construct
  misc_feature 1..1977: note = derived and/or modified CDS sequence (opt6) from DENV-3 Consensus__prME
  source 1..1977: mol_type = other RNA
tttcatttaacttcgagggatggagaaccaagaatgatagtagggaaaaatgaaagaggaaaaagtttactttttaaaactgcgtcaggaataaacatgtgtacattgatagcaatggatttaggagagatgtgtgatgacacagtaacatacaaatgtcctcatataacagaagtagaaccagaagacatagattgttggtgtaaccttacaagcacatgggtaacgtatgggacttgtaatcaagcaggagaacaccgaagagacaaaagaagcgtagcactggcgccacatgtaggtatgggactagacacaagaactcaaacatggatgtctgcagaaggagcatggagacaagtagaaaaagttgaaacatgggcgttacgacatccgggtttcacaatactggcactattcttagcacactatataggaactagcctaacacaaaaagtggttatattcatactattaatgttagttacacctagtatgacaatgcgatgtgtcggagttgggaacagagattttgtcgaaggattaagtggggcaacatgggtggatgtagtattagaacatggtggatgtgtaacaacaatggccaaaaacaaacccacattagatatagaattgcagaaaaccgaggcaacacaattagcaacattaagaaaattatgcatagaaggaaaaataacaaatataacaactgattcaaggtgtccaactcaaggcgaagcaacgttaccagaggaacaagatcaaaactatgtatgcaaacacacatatgtagataggggatggggaaatggatgtggactatttggaaaaggatcattagttacatgtgcaaagtttcaatgtttggaaccaatagaaggtaaagtagtccaatacgaaaatctaaaatataccgtaattataacagtacatacgggagatcaacatcaagttggtaatgaaacacaaggtgtaacagcagaaataacaccacaagcaagtactactgaagcaatattaccagaatatgggacattaggactagaatgtagtccaagaacaggactagattttaatgaaatgattctattaaccatgaaaaacaaagcatggatggtacatagacaatggtttttcgacttgccactaccatggacttcaggagcaacaacagagacaccaacatggaacagaaaagaactattagtaacatttaaaaatgcacacgctaagaaacaagaggtagtggtactaggttcacaagaaggtgcaatgcatacagctttaacaggagcaacagaaatacagaatagcggtggaacatccatttttgctggacatctaaaatgtagactaaaaatggataaattagagctaaaaggaatgagttatgcaatgtgcacaaatacattcgtattaaagaaagaagtttcagaaacacaacatggaacaatacttataaaagtcgaatataaaggagaagatgtcccatgcaaaattcctttttcaacagaagatggacaaggaaaagcacataacggacgactgataacggctaatccagtagtaactaaaaaggaagaaccagttaatatagaagcagaaccaccatttggtgaatctaatatcgtaatagggattggtgacaacgcattaaaaattaactggtacaagaaaggaagtagtataggtaaaatgtttgaagcaacagcaaggggagcaaggaggatggcaatattaggagataccgcatgggattttggatcagttggaggagtactaaatagtttaggaaaaatggtacaccaaatattcgggagtgcttatactgcactattttcgggcgtaagttgggtcatgaaaatagggataggagtactcctaacatggataggactaaatagcaaaaacacaagtatgagtttcagctgtatagcaataggaataataacattgtatttgggggcagttgtacaagca

SEQ ID NO: 2274 - RNA, 2019 nt, synthetic construct
  misc_feature 1..2019: note = derived and/or modified CDS sequence (opt6) from DENV-3 Consensus__SSc-prME
  source 1..2019: mol_type = other RNA
acatcactatgcttaatgatgattctaccagcagcattagcattccacttaacctcaagagacggagaacccagaatgatagtcggtaaaaatgaacgaggaaaatccttgctattcaaaacagcatcaggaataaacatgtgcacgctaattgctatggatctaggagaaatgtgtgatgatactgtaacatataaatgtccacatattacagaagtagaacctgaagatatagattgttggtgtaatctaacaagcacatgggtcacatatggaacatgtaatcaagcaggagaacatagaagagataaaagatcagttgcgttagcaccacatgtaggaatgggtctagacacgaggacacaaacatggatgtctgcagaaggagcatggagacaagtagagaaagttgaaacatgggcattaagacatcctggatttactatactcgcactcttcctagcacactatataggaacatcactaacacaaaaagttgtaatatttatattactgatgttagtaactccaagtatgacaatgcgttgtgtaggtgtaggtaacagagattttgtagaaggattaagtggagctacatgggtagatgtagtcctagaacatggaggttgcgtgacaacaatggcgaaaaataaaccaacattagatattgaattacagaaaacagaagcaacacaactggcaacactaagaaaactatgcatagaaggaaaaattacaaacataactacagattcaagatgtccaacccaaggtgaagcaactttaccagaagaacaagatcaaaattatgtttgtaaacatacatatgtagatagaggctggggaaatggatgtggattgtttggaaaagggagtctagtaacatgcgcaaaatttcaatgtttagaacctatagaaggcaaagtagtacaatacgagaatttaaaatatacagtaataataaccgtacatactggagatcaacatcaagttggaaatgaaacgcaaggagtaacagccgaaataaccccacaggcatcaactacagaagcaatactacctgaatacggtactttgggtttagaatgtagcccacgaacaggtttagattttaatgaaatgatcttattaacaatgaaaaacaaagcatggatggttcatagacaatggttcttcgatcttccattaccatggacgagtggtgctaccacagaaacaccaacatggaatagaaaagaactattagttactttcaaaaatgcacatgcaaagaaacaagaggtagtagtactaggctcacaagaaggagcaatgcatactgcgctaacgggcgcaacagagatacaaaacagtggtggaacctcaatatttgcaggacacttaaaatgtagattaaaaatggataaattagaactaaaaggaatgtcatatgcaatgtgtacaaacacgttcgtattaaagaaagaagttagtgaaacacaacatggcactatattgataaaagttgagtacaaaggcgaagatgtaccatgtaaaataccctttagcacagaagatggacaaggaaaagcacataacggaagactaataactgcaaacccagtagttacaaagaaagaagaaccagtaaacatagaagctgaaccgccatttggtgaatcaaatatagtgatcggcataggagataacgccttaaaaataaactggtataagaaaggaagctcaatcggaaaaatgtttgaagcaaccgcaagaggtgcaaggagaatggcaatacttggtgacacagcatgggatttcggaagtgtaggaggagttttaaactcactaggaaaaatggttcaccaaattttcggaagtgcatacacagctttattctctggagtaagttgggtaatgaaaataggtataggagtattattaacatggataggactaaacagcaaaaacacatcgatgagttttagttgtatagcaattggaatcattacattgtatttaggtgcggtagtacaagca

SEQ ID NO: 2275 - RNA, 1056 nt, synthetic construct
  misc_feature 1..1056: note = derived and/or modified CDS sequence (opt6) from DENV-3 Consensus__NS1
  source 1..1056: mol_type = other RNA
gacatgggatgtgtaataaattggaaaggaaaagaattaaaatgcggatcaggaatatttgtaacaaatgaagtccacacatggacagagcaatacaaatttcaagctgacagtccaaaaagattagcaacagccatagcaggagcatgggaaaacggagtgtgcgggataagaagtactactagaatggaaaatttactatggaaacaaatagcaaatgaattaaattatatattatgggaaaataatataaaattaacagtagttgtaggagatataataggagtattagaacaaggaaaaagaacattaaccccacaaccaatggaattaaaatacagctggaaaacatggggaaaagcaaaaatagtgacagcagaaacgcaaaatagcagttttataatagatggaccgaacactcctgaatgtccaagcgtaagcagagcatggaacgtatgggaagtagaagattatggatttggagtatttacaacaaatatatggttaaaattaagagaagtgtacacgcaattatgtgatcacagactgatgtcagcagccgtaaaagatgaaagagccgtgcatgcagacatgggatattggatagaatcacaaaaaaacggaagttggaaattagaaaaagccagtttaatagaagtaaaaacatgcacatggccaaaaagtcatacattatggagtaatggtgtacttgaaagtgatatgataataccgaaatcattagcaggaccaatatcacaacataatcatcgaccaggatatcatacacaaacagcaggaccatggcacttaggaaaattagaattagattttaattattgtgaagggacaacagtagtaataacagaaaattgcggaacaagaggtccaagcttaagaacaacaacagtatcaggaaaattaatacacgaatggtgttgtagaagttgcacactacccccactcagatacatgggagaggacggatgttggtacggaatggaaataagaccaataagcgaaaaagaagaaaatatggtaaaatcattagtaagcgca

SEQ ID NO: 2276 - RNA, 1857 nt, synthetic construct
  misc_feature 1..1857: note = derived and/or modified CDS sequence (opt6) from DENV-3 Consensus__NS3
  source 1..1857: mol_type = other RNA
tcaggcgtgttatgggatgtaccatcaccaccagaaacacaaaaagcagaactagaagaaggagtatacagaataaaacaacaaggaatcttcggaaaaacacaagtaggagtaggtgtacaaaaagaaggtgttttccatactatgtggcacgtaacaaggggtgcagtgttaacgtataacggcaaaagattagaacctaactgggcttcggtcaagaaagatctaattagttatggaggaggttggcgattaagcgcacaatggcaaaaaggcgaagaagtacaagtgatagcagtagaaccaggtaaaaatccgaaaaactttcaaacaatgccaggaacattccaaacaactacaggagaaataggagcaatagcattagactttaaaccaggaacatcgggtagtccaatcataaaccgagaaggtaaagtagtaggattgtacggaaatggagtagtaaccaaaaatggaggatatgtatcaggaatagctcaaacaaatgcggaacctgatggcccaacaccagaactcgaagaagaaatgttcaagaaaagaaatttaacaataatggaccttcatccaggtagtggtaaaacaagaaaatacttgccagcgatagtaagggaagcaataaaaagaagactacgaacactaatattagcaccaacaagagtagtcgcagcagaaatggaagaagccttaaaaggactccccataaggtaccaaacaacagcaacaaaaagtgaacacacgggaagggaaatagttgacctaatgtgtcatgctacatttacaatgagattactatcacctgtaagagtcccaaattataatctaatcataatggacgaagcacattttacagatccagcatcaatagctgcaagaggatacattagcaccagagtaggaatgggtgaagcagcagcaattttcatgacggcaacgccacccggtacagcagacgcatttcctcaatcaaacgcacctatacaagatgaagaaagggatattcccgaaagatcatggaacagtggaaatgaatggataacagactttgcaggaaaaacagtatggttcgtaccaagtattaaagcaggtaacgacattgctaattgtctacgcaaaaatggtaagaaagtaatacaactatcaagaaaaacatttgatactgaatatcagaaaactaaactaaatgattgggattttgtcgttacaacagatatttcagaaatgggagctaatttcaaagcagatagagtaatagatccaagacgatgcctaaaacctgtaattttaacagacggtccagaaagagtaattctagcaggacccatgccagttacagcagcttcagcagcacaaagaagaggaagagtaggaagaaatccacaaaaagaaaatgaccaatatattttcacgggtcaacctttaaacaatgatgaagaccatgcacattggacagaagcaaaaatgttattagataatataaatacacctgaaggaataataccagcattatttgaacctgaaagagaaaaatcagcagcaatagatggagaatatagactaaaaggagaaagccgaaaaacgttcgtggaactaatgagaagaggagacttaccagtatggttagcacataaagtagcgagtgaaggaataaaatacacagataggaaatggtgtttcgatggacaaagaaataatcaaatacttgaagaaaatatggatgttgaaatctggacaaaagaaggagagaaaaagaaattacgaccacgttggctagacgcaagaacgtattcagacccattagcactaaaagaatttaaagaatttgcagccgggagaaaa

SEQ ID NO: 2277 - RNA, 2319 nt, synthetic construct
  misc_feature 1..2319: note = derived and/or modified CDS sequence (opt6) from DENV-3 Consensus__C-prME
  source 1..2319: mol_type = other RNA
atgaacaaccaaagaaagaaaacaggaaaaccatccataaacatgttaaaaagagtaaggaaccgtgtaagcacaggatcacaactagccaagcgattttctaagggactattaaatggtcagggtcccatgaaactcgtaatggcctttattgcatttctacgctttctagcgataccaccaacagctggagtccttgcacgatggggaacttttaaaaaatcaggcgcaattaaagtcctcaaaggatttaaaaaagaaatatctaatatgttatcaataataaataaacgtaaaaaaaccagcttatgtcttatgatgatattaccggcggcacttgcattccacttaactagtcgagatggagaaccaagaatgatagtaggaaaaaatgaaagaggcaaaagcttattatttaaaactgcatcaggaataaatatgtgcacattaatagcaatggatcttggagaaatgtgtgacgacactgtaacttataaatgtccccatataacggaagttgaaccagaagacatagattgttggtgcaacttgacaagcacatgggtgacttatggaacatgtaatcaagcaggtgaacatagaagagacaagagaagcgttgctcttgcaccacatgtaggtatgggtttagatacaagaacacaaacttggatgagcgcagaaggtgcttggagacaagttgagaaagtagaaacatgggcactaagacaccccggattcacaatattagctctattcttagcgcattacatagggacctcgctaactcaaaaagtagtaatatttatattactaatgctagtgacacctagtatgactatgcgatgtgtaggagtaggaaatagagatttcgtagaaggattaagtggagcaacatgggttgatgtagtattagaacatggagggtgtgttactacgatggcaaaaaacaaaccgacactagacatagaattgcaaaaaaccgaagcaacacaactggcaactcttagaaaattatgtatagaaggtaaaataacaaacataacaactgactcaagatgtccaacacaaggcgaagcaacattaccagaagagcaagatcaaaattatgtatgtaaacacacttatgtagatcgaggctggggaaatgggtgcggcctcttcggaaaaggcagcttagtgacatgtgccaaatttcaatgtctagaacctatagaaggaaaagtagtccaatacgaaaacctaaaatataccgtaattataacagtacacacaggagatcaacatcaagtcggaaatgaaacacaaggagtaacggcagaaataacaccacaagcttccaccacggaagcgatactgccagaatatggaacacttggcttagaatgtagtccaagaacgggacttgatttcaacgaaatgatccttttaactatgaaaaataaagcatggatggtacataggcaatggttttttgatttacctctcccatggacaagtggggcaacgaccgaaacaccgacatggaacagaaaggaacttttagtaacattcaaaaatgcacatgcaaaaaaacaagaagtagtggtactaggatcacaagagggtgcaatgcatacagctttgacaggcgcaacagaaatacaaaattcaggaggaacctcgatatttgcaggacatttaaaatgtagactaaaaatggataaactagaactaaaaggtatgtcatatgccatgtgcacaaatacattcgtattaaaaaaagaagtctctgaaacgcaacacggcaccatactaatcaaagtagaatacaagggagaagatgtaccgtgtaaaataccattctccacagaagatggtcaaggaaaagcacacaacgggagactgataactgcaaacccagtagtaacaaaaaaagaagaacctgtaaatatagaagcagaaccaccattcggtgaaagcaatattgtaatagggataggagataatgcattaaaaataaattggtacaaaaaaggaagctctattggaaaaatgtttgaagcaacagcaagaggggccagaagaatggcaatactaggtgatacagcatgggattttggcagcgttggcggagtattaaactcactaggaaaaatggtacatcaaatattcggatcagcatatacggcacttttttcaggagtaagttgggtcatgaaaataggaataggagtactattaacatggataggactgaatagtaaaaatactagtatgagtttttcatgtatagcaataggaattatcacgttatacctaggagcggtagtgcaagca

SEQ ID NO: 2278 - RNA, 45 nt, synthetic construct
  misc_feature 1..45: note = derived and/or modified CDS sequence (opt6) from DENV-3 Consensus__SSc
  source 1..45: mol_type = other RNA
atgacatctctatgtctaatgatgattctacctgcagctctagct

SEQ ID NO: 2279 - RNA, 57 nt, synthetic construct
  misc_feature 1..57: note = derived and/or modified CDS sequence (opt6) from DENV-3 Consensus__SSopt
  source 1..57: mol_type = other RNA
atgaaaagaaaaaaaacatcactatgcctaatgatgatactaccagcagcactagca

SEQ ID NO: 2280 - RNA, 57 nt, synthetic construct
  misc_feature 1..57: note = derived and/or modified CDS sequence (opt6) from DENV-3 Consensus__SSm
  source 1..57: mol_type = other RNA
atgacacaaaaagtcgtaatattcatactactaatgctagtaacaccatcaatgaca

SEQ ID NO: 2281 - RNA, 1482 nt, synthetic construct
  misc_feature 1..1482: note = derived and/or modified CDS sequence (opt6) from DENV-3 Consensus__E
  source 1..1482: mol_type = other RNA
atgagatgcgtaggagttggaaatagagacttcgtagaaggattaagcggggcaacatgggtagacgtggtattagaacacggaggatgtgtaacaacgatggcaaaaaataaaccaacattagatatagagttacaaaaaacagaagcaacacaactagcaacattgaggaaattatgcatagaaggaaaaataacaaatataaccacagatagcagatgccctacccaaggtgaagcaacattaccagaagaacaagaccaaaattatgtatgtaaacacacgtacgtagacagaggctggggaaacggatgcggattatttggaaaaggtagtttagtaacatgcgcaaaatttcaatgtttagaaccaatagaagggaaagtggtacaatatgaaaacttaaaatatacagtaataataacagtacatacaggagatcaacaccaagtgggaaacgaaacacaaggagtaacagcagaaataacaccacaagcatcaacaacagaagcaattttacctgaatacgggacattaggattagaatgctccccaaggacggggctagactttaatgaaatgatactattaacaatgaaaaacaaagcttggatggttcataggcaatggttctttgatttaccattaccatggactagtggggcgactactgaaaccccaacatggaatagaaaagaactacttgtaacatttaaaaacgcgcatgcgaaaaaacaagaagtagtagtcttaggatcacaagaaggagcaatgcataccgcattaacgggagctacagaaatacaaaattcagggggaacaagcatatttgcaggacacttaaaatgcagattaaaaatggataaattagaattaaaaggaatgagctatgcaatgtgtactaacacattcgtactaaaaaaagaagtaagtgaaactcaacatggaacaatactaataaaagtcgaatataaaggagaagacgtaccatgtaaaataccatttagcaccgaagacggacagggaaaagcacataacggaagactaataaccgcaaatccagtagtaacaaagaaagaggaaccagtaaacatagaagcagaaccaccatttggtgaaagcaacatagtaataggaataggagacaacgcattaaaaataaactggtataaaaaaggatcaagtataggtaaaatgttcgaagcaacagcaagaggagcaagaaggatggcaatactaggagatacagcatgggattttggatcagtcggaggagtgctaaattcattaggtaaaatggtacaccaaatattcggaagtgcatacacagctttattttcaggagtatcatgggtcatgaaaataggtataggagtgttattaacatggataggactaaatagtaaaaatacaagtatgagtttttcgtgtatagcaatcggaattataacactatatctaggtgcagtagttcaagcataa

SEQ ID NO: 2282 - RNA, 1176 nt, synthetic construct
  misc_feature 1..1176: note = derived and/or modified CDS sequence (opt6) from DENV-3 Consensus__EdelTM-variant (aa1-392)
  source 1..1176: mol_type = other RNA
atgagatgcgtcggagtaggaaatagagactttgtagaaggattatcaggagcaacatgggtagacgtagtattagaacatggcggatgcgtaacaacaatggcaaaaaacaaaccaacactcgacatagaactacaaaaaacagaagcaacacaattagcaacactaagaaaattatgtatagaaggaaaaatcactaacataacaacagacagcagatgcccaacacaaggagaagcaacattaccagaagaacaagaccaaaactacgtatgtaaacacacctacgtagaccgaggttggggaaatggatgtggcctcttcggaaaaggatcacttgtaacatgcgcaaaattccaatgtctagaaccaatagaaggaaaagtagtacaatacgagaacctaaaatacacagtaataataacagtacacacaggagaccaacatcaagtaggaaacgaaacacaaggagttacagcagaaataacaccacaagcaagcacaacagaagctatactcccagaatatggaaccctaggactagaatgttcaccaagaacaggactagatttcaacgaaatgatactattaacaatgaaaaacaaagcatggatggtccacagacaatggttctttgacctaccattaccatggacaagcggagcaacaacagagaccccaacatggaacagaaaagaacttttagtaacatttaaaaacgcacatgcaaaaaaacaagaagttgtagtactaggatctcaagaaggtgcaatgcatactgcattaactggagcaaccgaaatacaaaactcgggaggaacaagtatattcgcaggacacctaaaatgtagactaaaaatggataaactagaactaaaaggaatgagctatgcaatgtgcacaaatacattcgttctcaaaaaagaagtatcagaaacacaacatggtacaatattaataaaagtagaatacaaaggagaagacgtaccatgcaaaatcccattctcaacagaagatggccaaggcaaagcacacaacggacgactaataacagccaacccagtagtaacaaaaaaagaagaaccagtcaatattgaagcagaaccaccattcggcgaatcaaatatagtaataggcataggagacaacgcattaaaaataaactggtacaaaaaa

SEQ ID NO: 2283 - RNA, 1269 nt, synthetic construct
  misc_feature 1..1269: note = derived and/or modified CDS sequence (opt6) from DENV-3 Consensus__EdelTM-variant (aa1-422)
  source 1..1269: mol_type = other RNA
atgagatgcgtgggagtaggaaacagagacttcgtagaaggactatctggagccacatgggtagacgtagtattagaacatggaggatgcgtaacaacaatggctaaaaataaaccaactttagatatagaactacaaaaaaccgaagcaacacaattagcaacactaagaaaactatgtatagaaggaaaaataacaaatataacaactgactccagatgtccaacacaaggcgaagcaacactaccagaagaacaagatcaaaattacgtatgcaaacacacatatgtagacagaggatggggaaacggatgtggcttattcggaaaaggatcattagtaacatgtgcaaaatttcaatgcttagaaccaatagaaggaaaagtcgtacaatacgaaaacctaaaatacacagtcataataacagtacatacaggggaccaacaccaggtaggaaatgaaacacaaggagtaacagcagaaataacaccccaagccagtacaacagaagctatactacccgaatacggcaccttaggattagaatgttccccaagaacaggcctagactttaacgaaatgatattactaacaatgaaaaataaagcctggatggtacacagacaatggttttttgacctaccattaccctggacctcaggagcaacaacagaaacaccaacttggaacagaaaagaactattagttacatttaaaaacgcacacgcaaaaaaacaagaagtagtagtattaggatcacaagaaggagcaatgcatacagcattaacaggagcaacagaaatacaaaattcaggaggaacaagtatatttgcaggacatttaaaatgcagactaaaaatggataaattagaattaaaaggtatgagctacgcaatgtgtacaaatacctttgtactaaagaaagaagtaagcgaaacacaacacggcacaatattgataaaagtcgaatataaaggcgaagacgtaccatgcaagataccctttagtacagaagatggacaaggtaaagcacataatggacgattaataaccgccaacccagtagtaacaaaaaaagaagaacccgtaaatatagaagcagaaccaccattcggagaatcaaacatagtaataggcataggtgacaacgcattaaaaataaactggtataaaaaaggaagtagtataggaaaaatgtttgaagcaacagcaagaggtgcacgaaggatggcaattttaggagacacagcctgggacttcggaagttaa

SEQ ID NO: 2284 - RNA, 1260 nt, synthetic construct
  misc_feature 1..1260: note = derived and/or modified CDS sequence (opt6) from DENV-3 Consensus__EdelTM-variant (aa1-419)
  source 1..1260: mol_type = other RNA
atgcgttgtgttggggttggaaatagagattttgtcgaaggattaagcggagcaacatgggtagacgtagtactagaacatggggggtgtgttaccacaatggcaaaaaataaaccaacactagatattgaactacaaaaaacagaagccacacaactagctacattaagaaaactatgcatagagggaaaaataacaaatataacaactgacagtagatgcccaacccaaggggaagcaacactcccagaagaacaagatcaaaattacgtatgcaaacacacgtacgtggacagaggatggggaaacggatgtggattattcggaaaaggaagcttagttacatgcgcaaaatttcaatgcctagaaccaatagaaggaaaagtagtacaatatgaaaatctaaaatatacagtaataataacagtacatacaggagatcaacatcaagtaggaaacgaaacacaaggagttacagcagaaataacaccccaagcatcaacaacagaggcaatattaccagagtacggtacattaggactagaatgttcaccaagaacaggattagattttaacgaaatgatattattgacaatgaaaaataaagcatggatggtacaccgacaatggtttttcgacctaccattaccatggacgagcggagcaacgacagaaacaccaacatggaatagaaaagaactcttagtaacatttaaaaacgcacacgctaaaaagcaagaagtcgtagtattaggatcacaagaaggagcaatgcacacagcattaacaggagcaactgaaatacaaaactcaggaggaacatcgatatttgccggacatttaaaatgtagactaaaaatggacaaattagagttaaaaggaatgagctatgcaatgtgcacaaatacgttcgtactaaaaaaagaagtatcagaaacgcaacatggaacgatattaataaaagtagaatacaaaggagaagacgtaccatgtaaaattccattcagtacagaagatggccaaggtaaagctcacaacggaagactaataacagccaatccagtagtaactaaaaaggaagaaccagtaaacatagaagcagaacctccctttggagaaagcaacattgtaataggaattggagacaatgcattaaaaataaactggtacaaaaaaggtagctcaataggaaaaatgttcgaagcaacggcaagaggcgctagaaggatggcaatattaggagatacagcatgggattaa

SEQ ID NO: 2285 - RNA, 1155 nt, synthetic construct
  misc_feature 1..1155: note = derived and/or modified CDS sequence (opt6) from DENV-3 Consensus__Edelaa101-107
  source 1..1155: mol_type = other RNA
atgagatgcgtcggagtaggaaatagagatttcgtagaaggattatcaggagcaacatgggtagacgtagtactagaacacggaggatgtgtaacaactatggccaaaaacaaaccaaccttagacatagaactacaaaaaactgaagcaactcaactagcaacattaagaaaactatgcatagaaggtaaaataacaaacataacaacagacagcagatgcccaacacaaggagaagcaacattaccagaagaacaagaccaaaactacgtatgtaaacatacatatgtagatagaggattcggaaaaggatcattagtaacatgtgctaaatttcaatgtttagaaccaattgagggaaaagtagtacaatacgaaaacctaaaatatacagtaataattacagtacacacaggcgaccaacaccaagtaggaaacgaaacacaaggagtaacagctgaaataacaccacaagcgtcaacaacagaagcaatactacccgaatacggaacactaggattagaatgtagccctagaacaggattagacttcaatgaaatgatattactaacaatgaaaaacaaagcatggatggttcacagacaatggttctttgatttaccactcccatggacatcaggagctaccacagaaacaccaacctggaatcgtaaagaactattagtaacattcaaaaacgcccacgcaaaaaaacaagaagtggttgtcttaggatcacaagaaggagcaatgcatacagcactaacaggagcgacagaaatacaaaactcaggaggaacaagtatattcgccggacacctaaaatgtagattaaaaatggacaaactagaactaaaaggaatgagctacgcaatgtgcacaaacacattcgttctaaaaaaagaagtaagtgaaacccaacatggaactatactaataaaagtagaatacaaaggagaagacgtgccatgtaaaataccatttagcacagaagacggacaaggtaaagcacacaacggcagattaataacagcaaatccagtagtaacaaaaaaagaagaaccagtaaacatagaagcagaaccaccattcggagaatcaaacatagtaataggaataggagacaatgcattaaaaataaactggtataaaaaa

SEQ ID NO: 2286 - RNA, 1173 nt, synthetic construct
  misc_feature 1..1173: note = derived and/or modified CDS sequence (opt6) from DENV-3 Consensus__EdelTM-variant (aa1-391)
  source 1..1173: mol_type = other RNA
atgagatgtgtaggagtaggaaacagagacttcgtagaaggactaagtggagcaacatgggtcgacgtagtactagaacatggaggatgcgtaacaacaatggctaaaaacaaaccaacactagatatagagctacaaaaaaccgaagcaacacaactagcaacactcagaaaattatgcatagaaggaaaaataacaaacataacaacagatagtagatgccccactcaaggagaagctacactaccagaagaacaagatcaaaactacgtatgtaaacacacatatgtcgacagaggatggggaaacggatgtggactattcggaaaaggaagcctagtcacatgcgcaaaatttcaatgcttagaaccaatagaaggaaaagttgtacaatatgaaaacctgaagtacacagtaatcataacagtacacaccggagaccaacatcaagtaggaaacgaaacacaaggagtaacagccgaaattacaccacaagcatcaaccaccgaagccatactaccagaatacggtaccttaggactagaatgtagtccaagaacaggattagattttaatgaaatgatattattaacaatgaaaaacaaagcatggatggtacacagacaatggttctttgacctaccactaccatggacaagtggagcaacaacagaaacaccaacctggaacagaaaagaactattagtaacatttaaaaacgcacacgcaaaaaaacaagaagtagtagtactaggaagccaagaaggtgcaatgcacaccgcacttacaggagcaacagaaattcaaaactcaggaggaacaagcatattcgcaggacacctaaaatgtcgactaaaaatggacaaattagaactaaaaggtatgtcatatgcaatgtgcacaaacacattcgttctaaaaaaagaagttagcgaaacacaacatggaacaatactgataaaagtagaatataaaggtgaagacgtaccctgcaaaataccattcagcacagaagacggccaaggaaaagcacacaacggaaggctaatcacagcaaacccagtagtaacaaaaaaagaagaaccagtcaatattgaagcagaaccacccttcggtgaatcaaacatagtaataggaataggagacaacgcactaaaaataaactggtacaaa

SEQ ID NO: 2287 - RNA, 2025 nt, synthetic construct
  misc_feature 1..2025: note = derived and/or modified CDS sequence (opt6) from DENV-3 Consensus__SSc-prME
  source 1..2025: mol_type = other RNA
atgacaagcttatgcctgatgatgatactacctgcggccttagcatttcatctaacatcacgagatggagaacctagaatgatagtagggaaaaatgaaagaggaaaaagtctattatttaaaacagcatcgggaataaatatgtgcacactaatagccatggacttaggcgaaatgtgcgatgatacagtaacttacaaatgcccacacataacagaagtagaaccggaagatatagactgttggtgcaatttaactagtacatgggtaacatatggaacatgcaatcaagcaggagaacataggagagacaaaagaagcgtagctttagctccacacgttggaatgggactagacactcgaacacaaacatggatgagtgcagaaggagcatggagacaagtagaaaaagtagaaacatgggctcttagacacccaggatttaccattttagcgttatttttagcacattacattggaacatccttaacacaaaaagttgtgatttttatattattaatgctagtgacaccaagcatgactatgagatgtgtaggagtaggaaatagagattttgttgaaggtctaagcggagcaacatgggtagatgtggttttagaacatggaggatgtgtaacaacaatggcaaaaaacaaaccaactctagacatagaactacaaaaaaccgaagctacacaattagcaacactaaggaaactgtgtatagaaggtaaaataacgaacataacaacagatagtcgatgtccaacacagggagaagctacactgccagaagaacaagatcaaaattatgtatgcaaacatacttacgttgatagaggatggggcaatggatgtggattatttggaaaaggaagtctagtaacatgtgctaaatttcaatgcctcgaaccaatagaaggcaaagtagtccagtatgaaaatctaaaatacacagtaataataactgtacatacaggagatcaacatcaagtaggaaacgaaacacaaggagttaccgcagaaataacgccacaagccagtaccacagaagcaatactacctgaatatggaacactaggtctggaatgctcaccaagaacaggtctagattttaatgaaatgatactattgactatgaaaaataaggcgtggatggtacatagacaatggttttttgacttaccactaccatggacgagcggtgcaacaacagaaacacctacatggaataggaaagaactcttagttacatttaaaaacgcacatgcaaaaaaacaggaagtagtagtattgggatcacaagaaggagctatgcatacagcattaacaggagcgaccgaaatccaaaactctggaggtacgagtatattcgcaggacatttaaaatgcagattaaaaatggacaaactcgaattaaaaggaatgagctacgcgatgtgtacaaatacatttgtattgaaaaaagaagtatcggaaacacaacatggcactattttaataaaagttgaatataaaggggaagatgttccatgtaaaataccttttagcacagaagacggtcaaggaaaagcccataacggaagactaataacagcaaacccagtagtgacaaaaaaggaagaaccagtaaacatagaagcagaaccaccatttggagaatctaatatcgtaataggaattggagacaacgcactgaaaataaattggtataaaaaaggaagttcaataggtaaaatgtttgaagcaactgctcgaggtgcgcgaagaatggcaatcctaggagacactgcgtgggattttgggagcgtaggaggtgtattgaacagtttgggaaaaatggtacatcaaatatttggatcagcttatacggcattattttctggtgtaagctgggttatgaaaatcggaatcggagtcttactaacatggatcggattaaatagtaaaaatacaagtatgagtttttcctgcatagcaataggtataataacactatacttaggtgcagtcgtacaagcttaa

SEQ ID NO: 2288 - RNA, 2025 nt, synthetic construct
  misc_feature 1..2025: note = derived and/or modified CDS sequence (opt6) from DENV-3 Consensus__SSc-prME(F108S)
  source 1..2025: mol_type = other RNA
atgacatcattatgcttaatgatgattttacccgcagcactagcctttcatctaacaagtcgagacggagaaccaagaatgatcgtaggaaaaaatgaaagaggtaaatcattactattcaaaacagcttctggaataaacatgtgtacattaattgctatggatctaggagaaatgtgtgacgacacagtgacctacaaatgcccccatataacagaagtagaaccagaagatatagattgttggtgtaatttaacaagtacgtgggttacttatggaacatgtaatcaagcaggcgaacacaggagggataaaagatcagtagcactagctcctcatgtgggaatgggtctagatacaagaacacaaacttggatgagcgcagaaggggcttggaggcaagtagaaaaagtagaaacatgggcattacgacatcctggattcacaattttagcactgttcctagcgcattatatcggaacctcacttacacaaaaagtagtaattttcatattacttatgttagtaacaccaagtatgactatgagatgtgttggggttgggaacagagattttgtcgaaggattaagtggcgcaacttgggtagatgtagtacttgaacatggcggatgtgttacaacaatggcaaaaaataaaccaactttagatatagaattacaaaaaacagaagcaacacaattagcaactttaagaaaactatgtatagaaggtaaaataactaacatcacaaccgacagtagatgtcctacacaaggagaggcaacattaccagaagaacaagatcaaaattacgtgtgtaaacatacgtacgtggatagaggatggggaaatggttgcggacttagcggaaagggatccttagttacatgcgcaaaatttcaatgtctagaacctatagaaggaaaagtagtccaatacgaaaatttaaaatataccgtaattatcactgtacatacaggcgaccaacatcaagtaggaaatgagacacaaggcgtaacagccgagataacaccacaagccagtaccacagaagcaattctacctgaatacggaacactgggattagaatgttcacctcgaactggactcgactttaatgagatgatattattaacaatgaaaaataaagcttggatggtacatagacaatggtttttcgatttaccactaccatggacaagtggtgcaacaactgaaacaccgacatggaatagaaaagaactattagttacatttaaaaatgctcatgctaaaaaacaagaagtagttgtactaggatcgcaagagggagcaatgcatacagcacttacaggagcaaccgaaatacaaaactctggaggaacaagtatatttgcaggacatttaaaatgtagattgaaaatggataaattagaacttaaaggaatgagctacgctatgtgcacaaatacttttgttttaaaaaaagaagtatcagaaacacaacacggaacaatactaataaaagtggaatataaaggagaagatgtaccatgtaaaattccatttagcacagaagatggtcagggaaaagcacacaacggaagattaataacagctaatcccgtagtaacaaagaaagaagaacccgtcaatatcgaagcagaaccaccatttggagaaagcaatattgtaataggtataggagataatgcattaaaaataaattggtacaaaaaaggatcctcaattggaaaaatgtttgaggcaacagctagaggagcaagaagaatggcaattttaggcgacactgcttgggactttggaagcgttggaggagtactaaattcactaggaaaaatggtacatcaaatatttggatctgcatacacggcactgttttctggagttagctgggtcatgaaaattggaataggtgtactattaacctggataggattaaatagtaaaaatacttctatgtcatttagctgtatagctattggaataataacactatatctaggtgcagtagttcaagcataa

SEQ ID NO: 2289 - RNA, 2025 nt, synthetic construct
  misc_feature 1..2025: note = derived and/or modified CDS sequence (opt6) from DENV-3 Consensus__SSc-prME(R186L)
  source 1..2025: mol_type = other RNA
atgaccagcttatgtttaatgatgatcttacctgccgctttagcatttcatctaacatcaagagacggcgaacccagaatgatagtagggaaaaatgaaagaggcaaaagcttgttatttaaaacagctagtggaataaatatgtgcacactaatagcaatggatctaggagagatgtgtgatgatacagtaacatataaatgtccacatataacggaagtagaaccagaagatatagattgttggtgtaatttgaccagcacatgggtgacttacggaacttgtaaccaagctggagaacatagaagagataaaagaagcgtagcattggctccacacgtaggaatgggacttgatacacggacacaaacttggatgtctgcagaaggagcatggagacaggtagaaaaagtagaaacatgggcattaagacatcctggatttaccatactagcactcttcttagcccattatattggaacctccttaacgcagaaagtggtgatctttatactactaatgctagttacaccaagtatgacaatgagatgtgtaggagtagggaatagagattttgttgaaggattaagcggagcaacgtgggtagacgtagttttagaacacggaggttgtgttacaacaatggcaaaaaacaaaccaactttagatatagaactacaaaaaacagaagccacacaattggcaacattaaggaaactgtgtattgaagggaaaataacaaacataacaaccgatagcagatgcccgacacaaggagaagcaacgttaccagaagaacaagatcaaaattacgtatgtaagcatacttacgttgatagaggatggggaaatggatgtggactattcggaaagggaagtcttgttacgtgcgccaaattccaatgtttggaacccatagaaggtaaagtagtacagtatgaaaatttaaaatataccgtaattataacagtacatacaggagatcaacatcaagttggaaatgaaactcaaggtgtaactgcagagataacaccccaagcatcaaccacagaagctatattacccgaatatggaactcttggactagagtgtagtccattaacaggtttagatttcaatgaaatgatattactaacaatgaaaaataaagcatggatggtacatagacaatggtttttcgatttgccattaccatggacatcaggagctacaacagaaacccctacatggaatagaaaagaactattagtaacattcaaaaacgctcatgcaaaaaaacaagaagtagtagtattaggatcacaagaaggagcaatgcataccgcattaacaggtgcaacagaaatacaaaactcaggaggtacatcaatatttgcaggacatctaaaatgtagattaaaaatggataaactagaattaaaaggtatgagttatgcaatgtgcacaaatacatttgtactaaaaaaagaagtctcagaaacacaacatggtacaatactaataaaagtagaatataaaggagaagacgtaccttgcaaaataccattttccaccgaagacggacaaggaaaagcacataacggaagattaataactgcaaaccctgtagtcacaaaaaaagaagagccagttaatatcgaagcggaaccgccatttggagagtctaatatagttataggaataggagataacgccctaaagataaattggtacaaaaaaggtagtagtataggaaaaatgtttgaggcaacagctagaggagcacgaagaatggcaatattgggtgatacagcgtgggattttggaagcgttggcggagtattaaattcactcggaaaaatggtacatcaaatatttggtagtgcatatacagcattatttagtggagtatcatgggtaatgaaaataggtataggagtcttattgacttggatcggactaaatagcaaaaatacatcaatgagcttcagttgtatagctatagggattataacattatatctaggtgcggtagtacaagcatag

SEQ ID NO: 2290 - RNA, 2025 nt, synthetic construct
  misc_feature 1..2025: note = derived and/or modified CDS sequence (opt6) from DENV-3 Consensus__SSc-prME(A265T)
  source 1..2025: mol_type = other RNA
atgacaagtctgtgtttaatgatgatcttaccagcagcattagcatttcatttaacatcaagagatggagaaccaagaatgatagttggaaaaaatgaaagaggtaaaagtttattattcaaaacagcatctggtataaatatgtgcacattaattgcaatggatctaggagaaatgtgcgatgacacagtaacatataaatgtccccatataacagaagttgaaccagaagatatagactgctggtgcaacttaacatccacgtgggtaacctacggaacttgtaatcaagctggagaacatagaagagataaaagaagtgtagcacttgcaccacacgtcggtatgggactagacacaagaacacaaacatggatgagcgctgaaggcgcatggcgacaagttgaaaaagtagaaacatgggcgctaagacaccctggatttacaatattagcattatttctagcacattatataggaacatcactgactcaaaaagttgtaatattcattcttttaatgttagtaacacctagtatgactatgcggtgtgttggagtcggaaatagagacttcgtagaaggcctaagcggagcaacatgggtggatgtagtcttagaacatggcggatgcgtcactacgatggcgaaaaataaaccaaccctagacatagaattacaaaaaacagaagctacgcaactcgcgacattacgaaaactgtgtatagaaggcaagataacaaatataacaacagactcaagatgtccaacacagggtgaagcaacattaccagaagaacaagatcaaaactacgtttgcaaacatacatacgtagatagaggatggggaaatggatgcggtttatttgggaaaggatccttagttacatgtgcgaaatttcaatgcttagaaccaatagaaggaaaagttgtgcaatatgagaacttaaaatatacagtcataataacagtacatacaggagatcaacatcaggtaggaaatgagacacaaggagtaacagccgaaataacaccacaagcatcaacaactgaagcgatattaccagaatacggaacgttgggactagaatgtagcccaagaacaggactagacttcaacgaaatgatattacttacaatgaaaaataaagcatggatggtacatagacaatggttttttgatttaccactaccatggacaagtggcgcaacaacagaaactccaacatggaacagaaaagagctattagtcacgtttaaaaacgcacatgccaaaaaacaagaagtcgtagtcctaggttcacaagaaggtgcaatgcatactgcacttacgggaacgacagaaatacaaaatagtggaggaacatcaatattcgcaggacatttgaaatgcagattaaaaatggacaaactagaattaaaaggaatgagttatgcaatgtgtacaaacacatttgtattaaaaaaagaagtatcagaaacccaacacggaacaatcctaatcaaagtagaatataaaggagaagatgtaccttgtaaaataccattttcaacagaagatggacaaggtaaagcacacaacgggcgtttaataacagcaaacccagttgtaacaaaaaaagaagaacccgtaaatatagaagccgaaccgccatttggagaaagcaacatagttataggaataggagacaatgcactcaaaataaattggtataagaaagggtcatcaataggtaaaatgttcgaagcaacagctaggggtgcaaggagaatggcaattttaggtgacacagcatgggattttggaagcgtaggtggagtattaaactcactgggaaaaatggtacatcaaatctttggttcagcatataccgctttattttctggtgtctcgtgggtaatgaagataggaataggagtattattaacatggataggattaaatagtaaaaacacaagtatgagtttcagttgtatagcaataggtataatcactctatacttaggagcagtagtacaagcataa

SEQ ID NO: 2291 - RNA, 2025 nt, synthetic construct
  misc_feature 1..2025: note = derived and/or modified CDS sequence (opt6) from DENV-3 Consensus__SSc-prMEdelstem_TM-JEV
  source 1..2025: mol_type = other RNA
atgacatctttatgcttaatgatgattttgccagcggcactggcatttcatttaacaagtagagatggagaaccaagaatgatagtaggcaaaaatgaacgtggaaaatccctactttttaaaactgcatcaggaattaacatgtgcacacttatagcaatggacttgggagaaatgtgtgacgatacagtaacatataaatgtcctcatataactgaagtagaaccagaagatatagactgttggtgtaatcttacaagcacatgggtaacatatggaacatgcaaccaagcaggagaacacagaagagacaaaagaagtgtagcattggctcctcatgtaggtatgggactggacacaagaacgcaaacatggatgtcagcagaaggggcatggagacaagtcgaaaaagtggaaacttgggcactaaggcatccaggatttacaattttagcattatttttagcacactatataggaacatcattaacacaaaaagtagtcatatttatcctattgatgttagtaactccatctatgacaatgagatgtgtaggcgttggaaacagagattttgtagaaggtctaagcggagcaacatgggttgatgtagtcctagaacacggcggatgcgtaactaccatggctaaaaataaaccaactttagatatagaattacagaaaactgaagcaacacaactggcaacattaagaaaattatgtatagaaggtaagataactaacataacaactgactcaagatgcccaacacaaggagaagcaactctaccagaagaacaagaccaaaactacgtatgtaagcacacgtacgtagatcgaggatggggaaatggatgcggcttatttggtaaaggtagtctagtcacatgtgcaaaatttcaatgtttagaacctatagaaggaaaagtagtacaatatgaaaatctgaaatatacagttataataacagtacacacaggagatcaacatcaagttggtaatgaaacacaaggagttacagctgaaataacaccccaagcatcaacaacagaggcaatactaccagaatatggaacgttaggtcttgaatgtagtccacgaactggtttggattttaacgaaatgatactcttaactatgaaaaacaaagcatggatggtacatagacaatggttctttgacctaccattaccatggacaagtggcgccactactgaaacacccacatggaatagaaaagaattattggtaactttcaaaaacgcacatgcaaagaaacaagaagttgtagtattaggatcacaagagggcgctatgcacacggcactaacaggagcgacagaaatacaaaattccggaggaactagcatatttgcagggcatttaaaatgtagattaaaaatggacaaactagaattaaaaggaatgtcatatgctatgtgtaccaatacattcgtactcaagaaagaagtttcagaaacgcaacatggcacaatattaattaaagtcgaatacaaaggagaagatgtaccatgtaaaattccattttcaacagaagacggtcaaggaaaagcacataatggaagattaatcacagcaaacccagtagtaacaaagaaagaagaaccagttaatatagaagcagaaccaccatttggagaaagcaatatagtaataggaattggagacaatgcattaaaaataaactggtataagaaaggatcaacattaggaaaagcatttagtactacattaaaaggagcgcaaaggttagcagcattaggagatactgcttgggattttggttctataggtggagtttttaactcaatcgggagagcagtacatcaggtatttggaggggcatttagaactttatttggaggcatgtcatggattactcaaggactaatgggtgcattgttgctttggatgggagtaaacgctagagataggagtattgcattggcatttcttgcaactggtggagtattagtatttttagctacaaatgtacatgcgtaa

SEQ ID NO: 2292 - RNA, 1326 nt, synthetic construct
  misc_feature 1..1326: note = derived and/or modified CDS sequence (opt6) from DENV-3 Consensus__SSm-EdelTM
  source 1..1326: mol_type = other RNA
atgacacaaaaagtcgtaatcttcatactactaatgctagtaacaccatccatgactatgagatgcgtaggtgtaggaaatcgagactttgtagaaggattatcaggcgcaacatgggtagacgtagtactcgaacatggaggatgcgtaacgacaatggcaaaaaataaaccaaccctggacatagaattacaaaaaaccgaagcaacccaattagcaacactacgaaaattatgcatagaggggaaaataacaaatataacaacagactcaagatgtccaacacaaggcgaagccacacttccagaagaacaagaccaaaattacgtatgcaaacacacatatgtagacagaggatggggaaacggctgcggactattcgggaaaggaagcttagtaacatgtgcaaaatttcaatgtttagaaccaatagaaggaaaagtagtacaatatgaaaacctaaaatatacagtaataataacagtacacacaggcgaccaacaccaagtaggaaacgaaacacaaggtgtaacagcagaaataacaccacaagcatcaaccaccgaagcaatacttccagaatatggaacactaggcctagaatgctctccaagaacaggattagactttaacgaaatgattttattaaccatgaaaaataaagcctggatggttcaccgacaatggttctttgacctacctcttccatggacatccggagcaaccacagaaaccccaacatggaacagaaaagaattattagtaacattcaaaaatgcacacgccaaaaaacaagaagtagtagtactaggctcacaagaaggagcaatgcacacagctttaacaggagccacagaaatacaaaactctggaggcacatcaatattcgcaggacacctaaaatgtagattaaagatggacaaactagaactaaaaggaatgtcatatgcaatgtgtacaaatacatttgtactcaaaaaagaagtatcagaaacacaacatggaacgatattaattaaagtagaatacaaaggagaagacgtaccttgcaaaataccattctcaacagaagacggacaaggaaaagcccacaacggaagactaatcacagcaaatccagtagtaactaaaaaagaagaaccagtaaacatagaagcagaaccaccattcggtgaatcaaatatagtaataggaataggagataatgcattaaaaatcaattggtataaaaaaggtagctcaattggaaaaatgtttgaggcaacagccagaggtgcgagaagaatggcaatactaggtgatacagcttgggatttcggatcataa

SEQ ID NO: 2293 - RNA, 2373 nt, synthetic construct
  misc_feature 1..2373: note = derived and/or modified CDS sequence (opt6) from DENV-3 Consensus__C-P2A-SSc-prME
  source 1..2373: mol_type = other RNA
atgaataatcaaagaaagaaaacgggcaaaccaagtataaatatgttgaaaagggtaagaaacagagtatcaaccggcagtcaactagcaaagagattttcaaaaggacttttaaacggacagggaccaatgaaactagtaatggcattcatagcatttctaaggtttctagcaataccgcctacagcgggagtattagcaagatggggaactttcaaaaaaagcggagcaattaaagtacttaaaggctttaaaaaagaaataagcaatatgctaagtataataaataaaagaaaaaaaaattttgacctactgaaattagcaggagatgtcgaaagcaatcccgggccaacaagcttatgcttaatgatgatactgccagcagctcttgcatttcacttaacctcaagagacggcgaaccacggatgattgtaggaaaaaacgaaagaggaaaaagcctactttttaaaacagcaagcggaataaatatgtgcactctaatagccatggacctaggtgaaatgtgtgatgacacagttacatataaatgcccacatattaccgaagttgaaccagaagacatagattgttggtgtaatttaacaagtacatgggtaacatatggaacctgtaatcaagcaggagaacatagaagagacaaaagatcagtggcattagcaccacacgtgggaatgggactagatactcgaacccaaacttggatgtccgcagaaggagcgtggagacaagtcgaaaaagtagagacatgggcactaagacacccagggttcacaatattagcattgttcttagcccattacatcggtacttctctcacacaaaaagtagtaatatttatacttctcatgctggtcacacctagcatgactatgagatgtgtaggcgttggaaaccgagactttgtagaaggattaagcggagcaacctgggtagatgtcgtactcgagcacggaggttgtgtaacaacaatggcaaaaaataaaccaacattggatattgaattacaaaaaacagaagctacacagttggcgactctacgaaaactttgtattgaaggaaaaataacaaacattacaacagatagtagatgtcctacacaaggtgaagcaacattaccagaagaacaagaccagaactatgtctgtaaacatacatacgtagataggggatggggaaatggttgtggcttatttggaaaaggttcattagttacatgtgcaaaattccagtgcttagaaccaatagaaggaaaagtagtacaatacgaaaatttaaaatatacagttataataaccgtccatactggagatcaacatcaagtaggaaacgaaacccaaggcgtaacagcggaaataacaccacaagccagcactacagaagctattctcccggaatacggaacattgggactcgaatgttcaccacgaactgggttggattttaacgaaatgattctattaacgatgaaaaataaggcatggatggtacacagacaatggttctttgatctacccctaccttggacaagtggggctacaacagaaacaccgacatggaatcgcaaagaattattagttacatttaaaaacgcacatgcaaaaaaacaagaagtagtagtactaggtagccaagaaggggcaatgcacacagctctaacaggcgcaacagagatacaaaacagtgggggaacatcaatattcgctggtcacttaaaatgtagattaaaaatggataaacttgaactaaaaggaatgagctatgcaatgtgcacaaacacgttcgttttaaaaaaagaagtaagcgaaactcaacacgggaccatattaattaaagtagaatacaaaggagaagatgttccttgcaaaataccattttcaacagaagacggacaaggaaaagcacataatggacggttaataacagcaaacccagtagtgactaaaaaagaagaacctgtaaatatagaagctgaaccaccgttcggagaaagtaatatagttattggaataggagataacgcactaaagatcaactggtacaaaaaaggaagttcaattggtaaaatgttcgaagctactgcacgaggggcaagacgtatggcaatactaggcgacacagcatgggattttgggtcagtaggaggcgtattaaacagtctaggaaaaatggttcaccaaatcttcggaagtgcatatactgcattgttttcaggagtatcatgggttatgaaaattggaataggtgttctattgacatggattggattaaatagtaaaaacacaagtatgagctttagttgcatcgcaatcggaataataacactatatctaggggcagtagtgcaagcttga

SEQ ID NO: 2294 - RNA, 2037 nt, synthetic construct
  misc_feature 1..2037: note = derived and/or modified CDS sequence (opt6) from DENV-3 Consensus__SSopt-prME
  source 1..2037: mol_type = other RNA
atgaaaagaaagaaaacttcgttatgtttaatgatgatattaccagcagctttagcttttcacttaacttcaagagacggagaacctagaatgatagtaggaaaaaatgaaagaggaaaaagtttgctatttaaaacagcatcaggcatcaacatgtgcacgctaatagcaatggatttaggtgaaatgtgtgacgatactgtaacttacaaatgcccacatataacagaagttgaaccagaagatatcgactgttggtgtaatttaacaagcacatgggtaacatatggaacttgcaatcaagcaggagaacatagaagagataaaagatcagtagcattagcaccacatgttggtatgggattagatacaagaacacaaacatggatgagtgcagaaggagcttggagacaagtagagaaagtagaaacatgggcactacgacatccaggattcacaatactagcactttttttagcacattacataggaacgagcctgacacaaaaagtagtaatttttatactgttaatgctagttacaccaagtatgactatgagatgtgtgggtgttggaaacagagattttgtcgaaggattaagcggagccacatgggtagacgtggtattagaacatggaggatgtgttactactatggctaaaaataaaccgacactagacatagaattacaaaaaacagaggcaacacaactagctacattaagaaaattatgtatagaaggaaaaataaccaatattacaaccgatagcagatgtccaacacagggagaagccactttaccagaagaacaagatcaaaattacgtttgcaaacacacatatgtggatagaggatggggaaacggatgcgggctatttggaaaaggatcattagttacatgcgcaaaattccaatgtctagaaccaatagaaggaaaagttgttcaatatgaaaatctaaaatatacagtaataataacagtccatacaggggaccaacatcaagttggaaatgaaacacagggtgtaacagctgaaataacacctcaagctagtactacagaggcgatactaccagaatatggaacattaggactagaatgttcgccaagaacaggtttggactttaacgaaatgatattactaacaatgaaaaataaagcatggatggtacacagacaatggttcttcgacctcccactaccatggacaagcggcgcaaccacagaaacacctacatggaaccgaaaagaactactagtaacattcaaaaatgctcatgcaaaaaagcaagaagtagtagttcttggttctcaagaaggcgcaatgcatacagcactcacaggagcgactgaaattcaaaattctggtggaacaagcatattcgctggacacctaaaatgtcgattaaagatggacaaacttgaactgaaaggaatgagttacgcaatgtgtacaaatacgtttgtactaaaaaaagaagtaagcgaaactcaacatggaacaattttaataaaagtagaatataaaggagaagatgttccctgtaaaatacccttctcaacagaagatggacaaggaaaagcacataatgggaggttaataaccgcgaatccagttgtcacaaaaaaggaagaaccagtaaatatagaagccgaaccaccatttggagaaagtaacatagttattggaataggagataatgctctaaaaatcaattggtataaaaaaggtagttcaattggaaaaatgtttgaagcaacggcaagaggagccagaagaatggcgatactaggagacacggcatgggattttggaagcgtaggaggggttttaaacagtttaggtaaaatggtacaccaaatattcggtagtgcatacacagcattattctcaggagttagctgggtaatgaaaataggaataggagtactattgacatggataggattaaatagcaaaaatacgtcaatgtctttctcatgtattgctatagggataattactctatacttaggagctgtagtacaagcttag

SEQ ID NO: 2295 - RNA, 2037 nt, synthetic construct
  misc_feature 1..2037: note = derived and/or modified CDS sequence (opt6) from DENV-3 Consensus__SSopt-prME(F108S)
  source 1..2037: mol_type = other RNA
atgaaaagaaaaaaaacatcattatgtctaatgatgatattacctgcagcactagcgtttcacttaacatcacgagatggcgaaccccgaatgatagtagggaaaaatgaaaggggcaaaagcttactatttaaaacagcatctggtataaacatgtgtacattaatagcaatggatttaggagaaatgtgtgatgacacagtaacatataaatgtccacacataactgaagtagaaccagaagatattgactgttggtgcaatttaacaagtacgtgggttacatacggaacatgtaatcaagcaggcgaacataggagagataaaagaagcgtagcactagccccacacgtaggtatgggattagatacaagaacacaaacatggatgtcagcagaaggagcatggcgacaggtagaaaaagtagagacatgggctctaagacatcctggttttaccattttagctctatttttagcacactatattggaacaagtttaacacaaaaagtagtcatatttatattgctcatgctagtaacacctagtatgacaatgcgatgtgtaggagtaggaaatagggattttgtagaaggattaagcggagccacatgggtagatgtagttctagaacatggaggatgtgtaaccacgatggctaaaaataaaccaactctagacatagaactacaaaaaacagaagctacacaattggcaactcttagaaaattatgtatagaaggaaaaataacaaacataactacggacagccgatgtccaacacaaggagaagcaacattacctgaagaacaagaccaaaattacgtttgtaaacatacatacgtggacaggggatgggggaatggctgcggactaagcggaaaaggaagtttggtaacgtgtgctaaatttcaatgtctagaacccatagaaggaaaagttgtacaatatgaaaacttaaaatatacagtaattataacagtacatacaggtgatcaacatcaagtcggaaatgaaacgcaaggcgtaactgcagaaataacacctcaagccagtacaaccgaggcaatattaccggaatatggaacactcggattggaatgtagcccaagaactggtttagactttaatgaaatgatattattaacaatgaaaaataaagcatggatggttcataggcaatggttcttcgatttgccattaccttggaccagtggggcaaccacagaaactccaacctggaatagaaaagaacttcttgtaacatttaaaaatgcacatgcaaaaaaacaggaagtagtagtcctaggatcacaagaaggagctatgcatacagcacttacaggcgcaacagaaattcaaaacagcggtggaacaagcatatttgcaggacacctaaaatgtcgattaaaaatggacaaattggaattaaagggaatgagctatgcaatgtgtacgaacacatttgtattaaaaaaagaagtatctgaaactcaacacggaacaatcctaataaaagtagaatataaaggagaagatgtaccatgtaaaataccattcagcacagaagatggacaaggcaaggcccataatggaagactaataacagcaaatccagttgtaactaaaaaagaagaaccggttaatatagaagcagaacctccatttggagaaagcaatatagtgataggaataggagacaacgctttaaaaataaactggtataagaaaggttccagtataggaaaaatgtttgaagcaacagcaaggggagctagaagaatggctatattaggagacacagcatgggatttcgggtcagttggtggtgtattaaacagcttaggaaaaatggtacatcaaatatttggtagtgcatacacagccttgttttctggagtatcatgggtaatgaaaataggcattggagttctactaacttggataggactgaatagtaaaaatacaagcatgagtttttcgtgcatagccataggaattataaccttgtatttaggagcagtcgtacaagcataa

SEQ ID NO: 2296 - RNA, 2037 nt, synthetic construct
  misc_feature 1..2037: note = derived and/or modified CDS sequence (opt6) from DENV-3 Consensus__SSopt-prME(H27N)
  source 1..2037: mol_type = other RNA
atgaaaagaaagaaaacaagtctatgtctaatgatgattttacctgcagcattagcctttcatttaaccagcagagatggagaaccaagaatgatagtaggaaaaaatgaaagaggaaaaagcttattattcaaaacagcaagcggaataaacatgtgcaccttaatagcaatggatctcggtgaaatgtgtgatgatactgtaacatataaatgtccacacataacggaagttgaacctgaagacatagattgttggtgcaatttgacaagtacatgggtaacctatggtacatgcaaccaagcaggagagcatagaagagataaaagaagtgttgcgttagcaccacatgtaggaatgggattggacactagaacccaaacatggatgagtgcagaaggagcatggagacaagtagaaaaagtagaaacatgggccctcagacatccaggctttacaatactagccctattcttagcacattatatcggaacaagcctaacacaaaaagtggtaatattcatattattaatgttggtaactccaagcatgacaatgagatgtgtgggagttggaaatcgagacttcgttgaaggactatctggtgctacatgggtagacgtagtattagaaaatggaggatgtgtaacaacaatggcaaaaaacaaaccaacactagatatagaacttcaaaagacagaagcgacacaacttgctacactaagaaagctatgcatagaagggaaaataacaaatataacaactgattctagatgtccaactcaaggagaagcgacattaccggaagagcaagatcaaaattacgtatgtaaacatacatatgtagatagaggctggggtaatggatgtggtttatttggaaaagggtcattagtaacctgcgcaaaatttcaatgtttagaacctatagaaggtaaagtagtccaatatgaaaatttaaaatacacagtaataataacagtccatacaggcgaccaacatcaagtgggtaatgaaacacaaggagttactgccgaaataacgccacaagcatccactacagaagcaatcttaccagaatacggaacattaggattagaatgtagtccacgaacaggattagactttaacgaaatgatattattaacaatgaaaaataaagcatggatggtccataggcaatggttctttgacttacctctaccatggacaagtggagcaaccactgaaacaccaacatggaacagaaaagagctactagtaacattcaaaaatgcacacgcaaaaaaacaagaagtagtagtattaggaagtcaagaaggagcaatgcacacagcattaacaggagccacagaaatacaaaattcaggaggaacttcaatattcgcaggacatttaaaatgcagactaaagatggacaaattagaactcaaaggaatgtcttacgcaatgtgtacaaatacatttgtactaaaaaaagaagtatcagaaactcaacatggtacaatactaataaaagtcgaatataaaggagaagacgtaccctgcaaaataccattttcaacagaagatgggcagggcaaagcgcataatggaagactaataacagcaaacccagtagtgacaaaaaaagaagagcccgtaaatatagaagcagaacctccatttggtgaaagtaacatagttataggaatcggagacaatgcactaaaaataaattggtacaaaaaaggaagttcaataggaaaaatgtttgaagcaacagcgagaggagctagacgaatggctattttaggagatactgcttgggatttcggatcagtaggcggagtattaaattccttaggtaaaatggtacatcaaatatttggaagcgcatatacggcgctattctcaggagtaagttgggtaatgaaaataggaattggagtactattaacatggatcggattaaacagcaaaaatacttcaatgagcttttcatgtattgcaataggaataataacactttatttaggggcggttgtacaagcttaa

SEQ ID NO: 2297 - RNA, 2037 nt, synthetic construct
  misc_feature 1..2037: note = derived and/or modified CDS sequence (opt6) from DENV-3 Consensus__SSopt-prME(T76I)
  source 1..2037: mol_type = other RNA
atgaaacgaaaaaaaacatcgttatgtttaatgatgatattaccagcggcattagcattccacttgacatcaagagacggagaaccaagaatgatagtaggaaagaacgaaaggggcaaatcattattatttaaaactgcctcaggcataaacatgtgtacattaatagcaatggacctaggagaaatgtgtgacgatacagttacatacaaatgtccacatataactgaagtagaaccagaagacattgattgttggtgcaatctaacatccacatgggtaacatatggaacatgtaatcaagcaggagaacacagaagagataaaagatcagtagcattagctccacacgtcggaatgggactagatacacgtactcaaacctggatgagtgcagaaggagcatggagacaggtagaaaaagtagaaacttgggctttaagacatccaggattcacaatccttgcattgtttttagcacattacataggaacctctcttacacaaaaagtggtgatatttatcttactaatgctagtaacgcctagtatgactatgcgatgtgtaggcgttggaaaccgagatttcgtcgagggattaagcggagcaacatgggtcgacgtagtattagaacatggaggttgtgtaacaactatggcaaaaaataaaccaacattagacatagaattacaaaaaacagaagcaacacaattagcaacactcagaaaactatgtatagaaggaaaaataaccaatattacaactgattcacgatgcccaattcaaggagaagcaacactacccgaagaacaagatcaaaattatgtgtgcaaacacacatacgtagatagaggttggggcaatggatgtggattatttggaaaaggctcactcgtcacttgcgcaaaattccaatgccttgaaccaatagaaggtaaagtagtacaatacgaaaatctaaagtacacagtaataataacagtacatacgggagatcaacatcaagtcggaaatgaaacacaaggagttacagcagaaatcacaccgcaagcatcaaccacagaagctatactgccagaatacggaacactaggtcttgaatgctcacctagaacaggattagactttaacgaaatgatattattaactatgaaaaataaagcttggatggtacatcggcaatggtttttcgatttaccacttccatggacaagtggagcaacaacagaaacaccaacttggaaccgcaaagaattactagtaactttcaaaaatgcacatgcaaaaaaacaagaagtagtagtcttaggatcacaagaaggagctatgcatacagctttaactggagcaacagaaatacaaaatagcggtggaacaagtatattcgcaggacatttaaaatgtaggttaaaaatggacaaattagaattaaaaggaatgagttatgcaatgtgtacaaacacgtttgtactaaaaaaagaagtatcagaaacacaacacggtacaatactaataaaagtagaatataaaggagaagatgtgccatgtaaaataccattctcaacagaagatggacaaggtaaagcacataatggacgactaattaccgctaatccagttgtcacaaaaaaagaagaaccagtaaatatagaagcagaacctccattcggagagagtaatatagtaatcggaataggagacaatgcccttaaaataaattggtataagaaaggctcaagtattggaaaaatgttcgaagccaccgcaagaggagcacgacgaatggcaatactaggcgatacagcctgggacttcggtagcgttggaggagtattaaattcattaggaaaaatggtacatcaaatattcggaagcgcgtatacagcattatttagcggggtttcttgggtaatgaaaataggaataggagtattactaacttggataggattaaactctaaaaacacatcaatgtcatttagctgtatagcaataggcataattacattatatttaggggcagtagtacaagcataa

SEQ ID NO: 2298 - RNA, 2037 nt, synthetic construct
  misc_feature 1..2037: note = derived and/or modified CDS sequence (opt6) from DENV-3 Consensus__SSopt-prME(N89D)
  source 1..2037: mol_type = other RNA
atgaagagaaaaaagacgagtttatgtttaatgatgattttacctgctgccttagctttccatttaacatcaagagatggagaaccaagaatgatagtaggaaaaaatgaaagaggaaaaagtctattatttaaaacagcaagcggaataaatatgtgtactttaatagctatggacctgggagaaatgtgtgacgacaccgtaacttataaatgtcctcatatcacagaagtagaaccagaagatatagattgctggtgcaacctaacgtcaacctgggtgacatatggaacttgtaatcaagccggagagcacaggagagacaaaagaagcgttgcattagcaccccatgttggaatgggattagatacaagaacgcaaacttggatgagtgcagaaggagcctggagacaagtagaaaaagtagaaacatgggctctaagacatccaggatttacaatactagcattatttctagcacactatataggaacatcattaacacaaaaagtagtcatttttatcttattaatgttagtaacccctagcatgacaatgagatgtgttggagttggaaaccgagactttgtagaaggtcttagtggagcaacatgggtcgatgttgtattagaacacggtggatgcgtaacaacgatggccaaaaataaaccaacattggatatagaattacaaaaaactgaagctacacaattagcaacgctaagaaaattatgtattgagggaaaaataactaatataacaacagatagcaggtgtccaactcagggcgaagcaaccttacctgaagaacaagatcaagattatgtatgtaaacacacttatgtagataggggatggggaaatggctgtggattatttggaaaaggaagcttagtaacgtgtgcaaaatttcaatgtcttgaaccaatagaaggaaaagtagttcaatatgaaaatcttaagtatacagtaataattacagtgcacacaggagatcaacaccaagtaggaaacgaaacgcagggggtaacggccgaaattacgccacaagcatcaaccacagaagcaatcttaccagaatatggaacactaggactcgaatgtagtcctagaacaggattagattttaacgaaatgatattattaacaatgaaaaataaagcgtggatggtacatagacaatggttctttgatttaccactaccatggacaagcggtgcaacgacagaaacaccaacatggaacagaaaagagctactagtaacattcaagaatgcacacgctaaaaaacaagaagtagtagtactaggcagccaagaaggtgctatgcatacagcactgacaggagcaaccgaaatacaaaactcaggagggacgtctatatttgcaggtcatttgaaatgcagattaaaaatggacaaattagaactaaaaggaatgtcttacgcaatgtgtacaaatacattcgtgctcaaaaaagaagtttcagaaacgcaacatgggacaatactgataaaagtagaatataaaggtgaagacgttccatgcaaaataccctttagcacagaagatggacaaggcaaagcacataatggaagactaataacagcaaatcccgtagtaacaaaaaaagaagagcctgtgaacatagaagcagaaccacctttcggtgaaagtaacatagtaataggtattggagataatgcgttaaaaataaattggtacaaaaaaggtagtagcataggaaaaatgtttgaagcaacagccagaggcgcaagaagaatggcaatactaggtgatacagcatgggactttggaagtgtaggtggagtattaaactcattaggaaaaatggtccaccaaatatttggaagtgcatatacagcactatttagtggagtgagctgggtaatgaaaataggaataggagtactacttacctggataggactcaatagtaaaaatacgagtatgtcttttagttgtatagcgatagggataataacattatatttaggagcagtagtacaggcgtaa

SEQ ID NO: 2299 - RNA, 2037 nt, synthetic construct
  misc_feature 1..2037: note = derived and/or modified CDS sequence (opt6) from DENV-3 Consensus__SSopt-prME(Y96H)
  source 1..2037: mol_type = other RNA
atgaagagaaaaaaaacaagtctatgcctcatgatgattcttccggctgcactagcctttcacttaacatcaagagatggagaacccagaatgatagtagggaaaaatgaaagaggtaaatcactattatttaaaacagccagtggaattaatatgtgtacattgattgcaatggatctaggagaaatgtgcgatgacacagtaacatataaatgtcctcatataaccgaagtagaaccagaagatatagattgctggtgtaatcttacaagtacatgggtaacatatggaacatgtaatcaagcaggagaacatagaagagataaacgatcagtagcactagcaccacatgtaggcatgggactagatacaagaacgcaaacatggatgagcgcagaaggggcatggagacaagtcgaaaaagttgaaacttgggcactaagacatccaggattcacaatactggcattatttctagcacattatattggtacaagtttaacacaaaaagttgtcatattcattttactaatgttggtaacaccaagtatgactatgagatgtgtaggagtaggaaacagagattttgtagaaggcttatcaggagcaacatgggtagatgtagtactagaacacggtggatgtgtgactacaatggcaaaaaataaaccaactctagacatagaactacaaaaaacagaagctacacagttagctacattaagaaaactgtgtatagaaggaaaaataacaaacattacaaccgatagtcgatgcccaacccaaggagaagcaacactcccagaagaacaagatcaaaattacgtttgtaaacatacacacgtagatagaggatggggtaatggctgtggattatttggaaaagggtcattagtaacatgtgcaaagttccaatgtttagaacctatcgaaggaaaagtagtacaatatgaaaatctaaaatataccgtaataatcacagtacacacaggagatcaacaccaagtaggaaatgaaacacaaggagtaacagctgaaataacaccacaagcttcaacaactgaagctatattaccagaatacggaactttaggactagaatgcagcccaagaacaggcctagactttaacgaaatgattttacttaccatgaaaaataaagcctggatggttcacagacaatggttctttgacttaccacttccatggacaagtggagcaacaacagaaacaccaacatggaatcgaaaagaactattagtaacttttaaaaacgcacacgcaaaaaaacaagaagtagttgttttaggctctcaggaaggagctatgcataccgcgttaacaggagcaacagaaatacaaaattcgggaggaacatccatattcgccggtcatttaaaatgccgattaaagatggataaacttgagctcaaaggaatgagctatgctatgtgcacaaatacttttgtactaaaaaaagaagtatcagaaactcaacatggaactatactaataaaggtagaatataaaggagaagatgtcccatgtaaaataccattttctacagaagatggtcaaggcaaagctcataacggacgtttaatcacagcaaacccagtagtcacaaaaaaagaagaaccagtaaatatagaagcagaaccaccatttggtgaatcaaatatagtcataggtataggagataatgcattaaaaataaattggtataaaaaaggttcaagtatcggcaaaatgtttgaagcaactgctagaggagcaagaagaatggccattttaggagatactgcttgggatttcggaagcgtgggcggagtactaaattctctcggaaaaatggttcatcaaatatttggttcagcatacacagcattattcagtggagtaagctgggttatgaaaatcgggataggtgttttattaacttggataggactaaatagtaaaaacacatcaatgtcgttttcatgtatcgcaataggaataataaccttatatttaggagcagtagttcaagcataa

SEQ ID NO: 2300 - RNA, 2037 nt, synthetic construct
  misc_feature 1..2037: note = derived and/or modified CDS sequence (opt6) from DENV-3 Consensus__SSopt-prME(K110E)
  source 1..2037: mol_type = other RNA
atgaagagaaaaaaaacatcactatgtttaatgatgatcttaccagcagccctagcttttcatttaaccagccgagatggagaaccaagaatgatagtaggtaaaaacgaaaggggaaaaagtctactatttaaaactgcatctggaataaacatgtgtacgttaatagccatggatttaggagaaatgtgtgacgatacagtgacttacaaatgtccccatatcacagaagtagagccggaagatatagattgctggtgtaatctaacatctacatgggtaacatatggaacatgcaatcaagcaggagaacatagaagagacaaaagaagtgtagcattagctccgcacgtaggaatgggattagataccagaacccaaacttggatgagcgcagaaggggcgtggcgacaggtagaaaaagtagaaacatgggcattgagacacccgggatttactattttagcattatttctagcacactatataggaacatctttaacacaaaaagtcgtgatatttatacttctaatgctagtcacacctagcatgacaatgagatgcgtaggggtgggaaatagggactttgtggaaggattatctggtgcaacatgggtagacgttgtactagaacatggcggatgcgtaactacaatggcaaaaaataaaccgacattagatatagaattacaaaaaaccgaagcaacgcaattagcaactttaagaaaattatgcatagaaggtaaaataacaaatatcacaacagacagtaggtgtccaacacagggtgaagccacattaccagaagaacaagatcaaaactatgtatgtaaacatacatatgtggatagaggatggggaaatggatgtggactatttggtgaaggctcattagtcacatgtgcaaaatttcaatgtctagaacctatagaaggaaaagtggttcaatacgagaatctaaaatacacagttataataacagtgcatacaggagatcaacatcaggttggaaacgaaacacagggagtaacagccgaaataacaccacaagcatcaacaacagaagctatactacctgagtacggtacactaggattagaatgttcaccaaggacgggactagatttcaacgaaatgattctattaaccatgaaaaacaaagcatggatggtacacagacaatggttttttgatctaccactaccatggactagcggtgctacaacagaaacaccaacatggaataggaaagaattattagtaactttcaaaaatgcacatgctaaaaaacaggaagtagtagtcttaggatcacaagaaggagcgatgcatacagcattaactggagcaactgaaatccagaattctggagggacaagtatatttgcaggacacttaaaatgtagactaaaaatggacaaactagaattaaaagggatgagctatgccatgtgtacaaacactttcgtcctaaaaaaagaagtaagtgaaacacaacatggaacaatactaattaaagttgaatacaaaggagaggatgttccctgcaaaattccattttccacagaagatggacaaggaaaagcacataatggaagattaatcacggcaaatcccgttgtaacgaaaaaagaagaaccagtcaatatagaagcggaaccaccattcggagaatcaaatatagtaatcggaataggagataatgcactaaaaataaattggtacaaaaaaggcagtagcataggaaaaatgttcgaagcaacggctcgaggagcgagaagaatggcaatattaggcgataccgcatgggatttcgggagcgtaggtggagtattaaactcactcggaaaaatggtacatcaaatatttggaagtgcttacaccgcgctatttagcggtgtaagttgggtaatgaaaataggaattggcgttctgcttacctggatagggttaaacagtaaaaacacaagcatgagctttagttgtatagcgataggaatcattacactatatttgggagcagtagtacaagcataa

SEQ ID NO: 2301 - RNA, 2037 nt, synthetic construct
  misc_feature 1..2037: note = derived and/or modified CDS sequence (opt6) from DENV-3 Consensus__SSopt-prME(H149N)
  source 1..2037: mol_type = other RNA
atgaaaagaaagaaaacatcattatgtttaatgatgatattaccagcagcattggcattccatttaactagcagggatggagaaccaaggatgatagtaggtaaaaacgaaagaggaaaaagtctattgtttaaaacagcaagcggaataaatatgtgtacactaattgccatggacctaggagaaatgtgtgacgatacagtaacatacaaatgcccacatataacagaagtagaaccagaagatatagactgttggtgcaatctgacaagtacttgggtaacttatggaacatgcaatcaggcaggagaacatagacgagataaaagatcggttgcactcgcaccacacgtaggaatgggactagatacaagaacacaaacatggatgtcagccgaaggagcatggcgacaggtggaaaaagtcgaaacttgggcacttcgtcacccaggatttacgattttagcactattcttagcacactatattggaacaagtttaacccaaaaagtagttatttttatactgctaatgctagtaaccccaagcatgactatgcgttgtgtaggcgtaggaaatagagattttgtagaaggattaagtggagctacgtgggtagatgtagtactcgaacatggtggttgtgtgacaacaatggctaaaaacaaaccgacattagatatagaattgcagaaaacagaagcgacacaattagcaactctaagaaaattatgcatagaaggaaaaataacaaatataacaactgacagtagatgcccgacacaaggcgaagcaacattaccagaagaacaagatcaaaattatgtatgtaaacatacatatgtagatagaggctggggtaacggatgtggattatttggtaaagggagcttagtaacatgcgctaaatttcaatgtttagaacctatagaaggaaaagtggtacaatatgaaaacctaaaatatacagtaataataactgtacatacaggtgatcaaaatcaagttggaaatgaaacacaaggagtgacagcagaaattacaccccaggcttcaacaacagaagcaattttaccagaatacggtacattaggattagaatgcagcccaagaactggcctagactttaacgagatgatattactaacaatgaaaaataaggcatggatggttcatcgacaatggtttttcgatttaccacttccgtggacaagtggggccacaacagaaacaccaacatggaatagaaaagaactattagtaacatttaaaaatgcgcatgctaaaaagcaagaagtagtagttctcggatcacaagaaggtgcaatgcatactgcattaacaggagcaactgaaattcaaaatagcggtggaactagcatatttgcagggcacttgaaatgcagattaaaaatggacaaacttgaactaaaaggaatgagctatgcgatgtgtacaaatacattcgtattaaagaaagaagtgagcgaaacacaacacggaacaatattaataaaagttgaatacaaaggcgaagacgtaccttgtaaaatacccttcagtaccgaagacggtcaaggaaaagcacataatggacgcttaataactgcaaatccagtagtaacaaagaaagaagaaccagtaaacatagaagcagaaccaccatttggagaaagcaatattgtgataggaataggggacaacgcactgaaaataaactggtataagaaaggaagctcaataggtaaaatgtttgaagctacggcacgaggagccagaaggatggcaatattaggtgatactgcatgggactttggaagtgttggaggagtactaaattcactcggcaaaatggtacatcaaatatttggaagtgcatacactgccttattctcaggagtaagttgggtcatgaaaataggaattggagtgttactaacatggataggtttaaatagtaaaaatacaagtatgtcattcagctgtatagcaataggtatcataacattatacttgggtgcagttgtacaagcatag

SEQ ID NO: 2302 - RNA, 2037 nt, synthetic construct
  misc_feature 1..2037: note = derived and/or modified CDS sequence (opt6) from DENV-3 Consensus__SSopt-prME(S184F)
  source 1..2037: mol_type = other RNA
atgaaaagaaagaaaactagcttatgtttaatgatgatactgccggctgccctagcatttcatttgacaagtagagacggagaaccaagaatgatagtaggcaaaaacgaacggggaaaatcactactctttaaaacagcttcaggaattaacatgtgtacactaatagcaatggatctaggagaaatgtgcgatgatacagtaacttacaaatgtccccatataacagaagtagaaccagaagatatagattgctggtgtaatctaacatcaacatgggtaacatatggaacatgcaatcaagcaggagaacatagaagagataaaagatcagtggcattagccccacatgtaggaatgggactagacaccagaacacaaacttggatgagtgctgaaggagcatggagacaagttgaaaaagtagaaacatgggcattaagacacccaggatttacaatcctagcattatttcttgcgcattatataggaacctcacttacacaaaaagtagtaatctttatactattaatgctagtaacccccagcatgacaatgagatgtgtaggtgttggtaacagagattttgtagaaggattatcaggagcaacatgggtagacgtggtactagaacatggaggatgtgtaacaacaatggctaaaaataaaccaacactggacatagaattacagaaaacagaagcaacacaactagcaacactaagaaaattatgtatagaaggaaagattacaaatataacaacagacagtagatgcccgacccagggtgaagcaacgttaccagaagaacaagaccaaaattacgtatgcaaacacacatatgtagacagaggttggggcaatggatgtggtttatttggcaaaggaagtttggtaacatgtgcaaaatttcaatgtctcgaaccaatagaaggtaaagtagttcaatacgaaaatttaaaatataccgtcataattaccgtacatacaggcgatcaacaccaagtaggaaatgaaacccaaggcgtcacagcagaaataaccccacaggcaagcaccacagaagcgattttgcctgaatacgggacattaggattagaatgttttccacgaacaggattagacttcaatgaaatgattttattaacaatgaaaaataaagcatggatggttcataggcaatggttctttgatttaccattaccatggacgagcggagcaaccacagaaacaccaacttggaatagaaaagagctcttagttacattcaaaaacgcgcatgctaaaaagcaagaagtagtagtattaggatctcaagaaggagcaatgcacactgcactaacaggagccactgaaatacaaaattcaggaggaacgtcaatatttgcaggacacctaaaatgtagattaaaaatggataaactagaactaaaaggaatgagttatgccatgtgtacaaatacattcgtattaaagaaagaagtcagcgaaactcaacatggaactatattaataaaagttgaatataaaggagaagatgtaccctgcaaaataccatttagtactgaagatggacaaggaaaagcacacaatggacgattaataacagctaacccagtagtaacaaagaaagaagaaccagtaaacattgaagcagaaccacctttcggcgaaagtaatatcgtaattgggataggcgataatgctttaaaaataaattggtacaagaaaggttcttcaataggaaaaatgtttgaggctactgcaagaggtgctagaagaatggcaatactaggggatacagcatgggatttcggatccgtaggaggggtacttaatagtctaggtaaaatggtgcatcaaatatttggaagtgcttatacagcactgttctcgggtgtatcatgggtcatgaaaatagggattggagttttattaacttggataggattaaatagtaaaaatacaagtatgtcattttcatgtatagcgataggaattataactttatacttgggagcagtcgtacaagcataa

SEQ ID NO: 2303 - RNA, 2037 nt, synthetic construct
  misc_feature 1..2037: note = derived and/or modified CDS sequence (opt6) from DENV-3 Consensus__SSopt-prME(R186L)
  source 1..2037: mol_type = other RNA
atgaaaagaaagaaaacatccctatgtctaatgatgatattgccagctgcattagcattccatttgacaagcagagatggagaaccccgaatgatagtcggtaaaaatgaaagaggtaaatcactattatttaaaacagcttcaggaataaatatgtgcacgctaatagccatggatttaggagaaatgtgtgatgatacagttacatataaatgcccacatataacagaagtagaaccagaagatatagactgttggtgcaacttaacaagcacgtgggtcacttatggaacatgtaaccaagcgggcgaacaccgacgagataaaagatcagtagccctagcacctcatgtaggaatgggactagacaccagaacacaaacatggatgtcagcagaaggagcatggagacaagttgagaaagtagaaacatgggctttaagacatccaggtttcacaatactagctttgtttttagcacattacatcggaacatcactaacacaaaaagtggtaatttttattctactcatgttagttacaccatcaatgaccatgaggtgtgtaggagttggaaacagagacttcgtagagggcttaagtggagccacatgggtagacgtagttttagaacatggaggttgtgtaacaacaatggccaaaaataaaccaactctagacatagaattacaaaaaacagaagccacacaactagcaacactacgaaaactatgtatagaagggaaaataactaatataacaaccgattcacgatgcccaacacaaggtgaagcaactttaccagaagaacaagatcagaattatgtttgcaaacatacatatgttgaccgaggttggggaaacggatgtggtctatttggaaaaggaagcctagtaacatgtgctaaatttcaatgcttagaaccaatagaaggaaaagtagtacaatacgaaaatttaaaatatacagttatcatcaccgtgcacactggggatcaacatcaagtggggaatgaaacacaaggagtaacagctgaaataacaccacaagcaagtacaacagaagccatattacctgaatatgggacattaggactagaatgctccccactcactgggttagattttaatgaaatgatattattaaccatgaaaaacaaagcatggatggtccacagacaatggtttttcgatttaccattaccatggacatcaggagcaacaacagaaacaccaacatggaacagaaaagaattattagtaacattcaaaaatgcacatgctaaaaaacaagaagtagtggttctaggaagtcaagaaggagcaatgcacacagccctaactggagcaacagaaatacaaaactctggcggcacaagcatatttgctggacatctaaagtgtagattaaaaatggataaattagagcttaaaggtatgagttatgcaatgtgtacaaatacatttgtgttaaaaaaagaagtctcagaaacacaacatggaaccatactaataaaagttgaatacaaaggagaagatgttccatgtaaaataccattcagtacagaggatggacaaggaaaagcacataatggaagactaataactgcaaatccagtagttactaaaaaagaggaaccagtaaatattgaagcggaaccaccattcggagaaagtaatatagtgataggaataggtgataatgcactaaaaataaattggtacaaaaaaggatcatcaattggaaaaatgttcgaagcaacagcaaggggcgctaggagaatggccatattaggggacacagcatgggattttggaagcgtaggaggagtattaaattctctaggtaagatggtacatcaaatatttggttcggcatacacagcactattttcaggtgtaagttgggttatgaaaataggaataggtgtgttactaacatggataggtttaaatagtaaaaacacgagtatgagtttcagctgtatagcaataggaataataacactatatctaggtgcggtagtacaagcataa

SEQ ID NO: 2304 - RNA, 2037 nt, synthetic construct
  misc_feature 1..2037: note = derived and/or modified CDS sequence (opt6) from DENV-3 Consensus__SSopt-prME(N240S)
  source 1..2037: mol_type = other RNA
atgaaaagaaaaaaaacaagtctatgcttaatgatgatattaccagcagcactagcattccacctaacatcacgagatggtgaacccagaatgatagtaggaaaaaatgaaagaggaaaatctcttctatttaaaacagcttctggaataaacatgtgcacactaatagctatggacctaggagaaatgtgcgatgacactgtaacatacaaatgtccacatatcacagaagtggaacctgaagatatagattgttggtgtaatctaacaagcacctgggtgacgtatggaacatgcaatcaagcaggtgaacacaggagagataaaagaagcgtagcactagctccacacgtcggaatggggttggatacacgaactcaaacgtggatgagcgcagaaggtgcatggcgtcaagtagaaaaagttgaaacatgggcgctgagacacccaggttttacaatattagctctatttttagctcattacataggaacatctttaactcaaaaagtcgtaatatttattttactaatgctagtaacaccatcaatgacaatgagatgcgttggagtaggaaatagagatttcgttgagggattaagtggagcaacatgggttgacgtagtattagaacacggaggctgcgtaacaactatggctaaaaacaaaccaacattagacatagaacttcaaaaaacagaagctacacaattagcaacactaagaaaattatgtatagaaggaaaaataacaaatataaccacagatagtagatgtccgacacaaggtgaagcaacgctaccagaagaacaagatcaaaactatgtttgtaaacatacatacgtggatagaggatggggaaatggctgtggtctgttcggcaaaggatcattagtaacatgcgcaaaatttcaatgtctagaaccaatagaaggaaaagtagtgcaatatgaaaaccttaaatacacagtaataataaccgtccacacaggagaccaacatcaagtaggaaacgaaacacaaggagtcacagcagagataacgccacaagcaagtacaacagaagcaatactaccagaatacggaacattaggactagaatgttcaccaagaacaggactagactttaatgaaatgatactattaactatgaaaaataaagcatggatggttcatagacaatggttctttgacctaccactaccgtggacgagcggagcaacaactgagactccaacttggaatagaaaagagctattagtaacatttaaaagtgcacatgcaaaaaaacaggaggtagtagtattgggatcacaggaaggagcaatgcatacagcattaactggcgcaaccgagatacaaaattcgggaggaacatcaatatttgcaggacatcttaaatgtagacttaaaatggataaactcgaactaaaaggcatgagctatgcaatgtgtactaatacatttgtactgaaaaaagaagtttcagaaacgcaacatggtacaatattaatcaaagtagaatataaaggagaagacgtaccatgcaaaataccatttagtacagaagatggacaaggcaaggctcataacgggagacttataacagccaatcctgtagtaacaaaaaaagaagaaccggtaaacatagaagcagaaccgccgtttggcgaaagcaatatagtgataggaatcggggacaatgctctaaaaataaattggtacaaaaaaggaagcagtataggaaaaatgtttgaagccacggcaaggggagcaagaagaatggccattttaggagacacagcatgggatttcggcagtgtaggaggggttttaaattcactaggaaaaatggtacatcaaatattcggaagcgcatacacagctttattctcaggagttagctgggtaatgaaaataggtataggagtactattgacctggattgggttaaatagtaaaaacacaagtatgagcttttcatgtattgcaataggaataataacattatacctaggggccgtagtgcaagcatga

SEQ ID NO: 2305 - RNA, 2037 nt, synthetic construct
  misc_feature 1..2037: note = derived and/or modified CDS sequence (opt6) from DENV-3 Consensus__SSopt-prME(M258L)
  source 1..2037: mol_type = other RNA
atgaaacgtaaaaaaacatcactttgcctaatgatgatattacccgcagctctagccttccacttaactagtcgtgatggagaaccaaggatgatagtaggaaaaaacgaaagaggtaaatcattattatttaaaacggcatcaggaataaacatgtgcacattaatagcaatggatttaggcgaaatgtgtgatgatacagtaacatataaatgtccacatatcactgaggtagaaccagaggacattgattgctggtgtaacttaacttcaacatgggtaacatatggaacatgtaaccaagcaggagaacatagaagagacaaaaggagtgtagctttggcaccacacgtaggaatgggtctagatacaagaacacaaacatggatgtcagcagaaggagcatggagacaagtagaaaaagtagaaacatgggcactaagacatcctggatttacaatactagcattatttttagcacattatattggaacaagcctcactcaaaaagtagttatatttattttattaatgttagtaacaccaagcatgacaatgagatgtgtaggagtaggaaacagagactttgtagaagggctaagcggagcaacatgggtagacgtcgtgttagaacatggaggatgtgtaacaacaatggcaaaaaataaaccgacattagatatagaactacaaaaaactgaagcaacacaactagcaacattaagaaaactatgtatagaaggaaaaataacaaacattaccaccgacagcagatgtccaacacaaggagaagcaacgctaccagaagaacaagaccaaaattacgtatgcaaacatacttatgtagatcgaggctggggaaacggatgtggattatttggaaaaggatcattggtaacatgtgctaaatttcaatgtctcgaacctattgaaggaaaagtagtacaatatgagaacttaaaatacacagtaattataacggtacatactggagaccaacatcaagtaggtaatgaaacacaaggtgtaacagcagaaattacaccgcaagcatcaaccaccgaagctatattaccagaatatggtaccctaggcttagaatgtagcccaagaacaggactagattttaatgaaatgatactattaaccatgaaaaacaaagcatggatggtacatagacaatggttttttgacctcccgctaccctggacatcaggagcgactactgagacacctacatggaaccgaaaagaattactagtcacttttaaaaatgcccatgctaaaaaacaagaagttgtggtactaggaagccaagaaggggccttacacacagcattaacgggtgctacagaaatacagaattcaggtggaacatcaatattcgcaggtcatctaaaatgtagattaaaaatggacaaattagaactcaaaggtatgtcatatgccatgtgtacaaatacattcgtattaaaaaaagaagtctcagagacacaacatggaactatcctaataaaggtcgaatataaaggggaagatgtaccttgtaaaatccctttttcaacagaagacggccaaggaaaagctcacaatggaaggctaataacagcaaatcccgtagtaacaaaaaaagaagaaccagttaatatagaagcagagccaccatttggcgaaagtaacatagtaattgggataggagacaacgcgctgaaaataaattggtataaaaaaggtagtagtataggaaaaatgtttgaggcaaccgcaagaggtgcaagaagaatggcaatattaggtgacacagcatgggacttcggaagtgtaggtggagtattaaattcgcttggcaaaatggtacatcaaatatttggaagtgcatacacagctctatttagcggagttagctgggtaatgaaaataggtattggagtactacttacatggatagggttaaatagtaaaaatacaagtatgtcttttagctgcatagctattggaataataacactatatttaggtgcagttgtacaagcataa

SEQ ID NO: 2306 - RNA, 2037 nt, synthetic construct
  misc_feature 1..2037: note = derived and/or modified CDS sequence (opt6) from DENV-3 Consensus__SSopt-prME(H259N)
  source 1..2037: mol_type = other RNA
atgaaacgaaaaaaaacaagtctatgcttaatgatgatcctgccagcagcactagcttttcatttaacttcaagagatggcgaaccacgaatgatagttggaaaaaacgaaagaggaaaaagtttattatttaaaactgcatcaggaatcaacatgtgtacgttaattgccatggatttaggcgagatgtgtgatgatactgtaacatataaatgtccccatatcacagaagttgaaccggaagacatcgattgttggtgtaaccttacaagcacatgggtaacatacggaacatgtaatcaagcgggagaacatagaagagacaaaaggagtgttgcgttggcaccacacgtaggaatgggactagatacgcgaacacaaacttggatgagtgctgaaggagcatggagacaagtagaaaaagtagaaacttgggcacttagacacccgggctttaccatattagcattatttctggcacattatatcggaacatcactaactcaaaaagtagttatatttatacttcttatgctagtgacacctagcatgacaatgcgatgcgtaggagtaggaaacagagactttgtagaaggcctaagtggagcaacctgggtagatgttgtactagaacacggtggttgtgtaacaactatggcaaaaaataaaccaactctagacatcgaactacaaaaaacagaagcaactcaattagctacactaagaaaattgtgcatagaaggaaaaataacaaacataacgacagattcacgatgtccaacacaaggtgaagcaacattaccagaagaacaagatcaaaattatgtatgtaaacatacctacgtcgacaggggatggggaaatggatgtggcttatttggaaaaggtagcttagtaacatgcgctaaatttcaatgtttagaaccgatagaaggtaaggtagtacaatatgaaaatttaaaatacacagtaataataactgtacacacaggcgaccaacatcaagttggtaatgaaacacaaggagtaacggcagaaataactccacaggcttcaacgacagaagcaatactcccagagtatggaacattaggattagaatgcagcccaagaacaggcttagattttaatgaaatgatactattaacaatgaaaaataaagcttggatggttcatcgacaatggttttttgatttacccttaccatggacatcaggagcaactacagaaacaccaacatggaatagaaaagaattattagtaacatttaaaaatgcacatgcaaaaaaacaagaagtggtagtcctagggtcacaagaaggagccatgaacaccgcgttaacaggagcaacagaaatccaaaatagtggtggaacatctatattcgcaggtcatttgaaatgtcgcctcaaaatggacaaactcgaactaaaaggaatgtcatatgctatgtgtacaaatacattcgtactaaaaaaagaagtcagtgaaacacaacatggaacaatactcataaaagtcgaatataaaggcgaagacgtaccctgtaaaataccatttagcaccgaagacggacaaggaaaggcacataacggaagactaattacagctaatccagttgtaactaaaaaagaagaacccgttaacatagaggcagaacctccattcggcgaaagtaatatagtaatcggaataggggataatgcattaaaaataaactggtacaaaaagggtagcagtataggaaaaatgtttgaagcaacagcaagaggcgccagaagaatggcaatattaggtgatactgcatgggactttgggtctgtaggaggagtccttaatagccttggaaaaatggtacaccaaatctttgggagcgcatacacagcattatttagtggagtaagttgggtaatgaaaataggaataggagtcctattaacatggataggactaaatagcaaaaacacaagtatgtcgttcagttgtatagcaataggaataataaccttgtatttgggagcagtcgtccaagcttaa

SEQ ID NO: 2307 - RNA, 2037 nt, synthetic construct
  misc_feature 1..2037: note = derived and/or modified CDS sequence (opt6) from DENV-3 Consensus__SSopt-prME(H259R)
  source 1..2037: mol_type = other RNA
atgaaaagaaaaaagacaagtttatgcctaatgatgatactacctgcagctctagcatttcatttaacgtcccgagacggcgaaccgaggatgattgtaggaaagaatgagagaggaaaatcattactatttaaaactgcaagcggaataaacatgtgtacattaatagcaatggacctcggagaaatgtgtgacgatactgtaacatacaaatgtcctcacattacagaagttgaaccagaagacatagattgttggtgtaatttaacatctacttgggtaacttatggaacatgtaatcaggcaggggagcataggagagataaaagatctgtagccttggcaccacatgtaggcatgggattagacacaagaacacaaacatggatgagtgcagaaggggcatggagacaagtagaaaaagtagaaacatgggctctcagacatccaggttttacaatactagcactatttctagcacattatatagggacatcattaacacaaaaagtagtaatattcatattattaatgttagtcacaccgagtatgacaatgaggtgcgtcggagttggaaatagagactttgtcgaaggcttaagtggcgctacatgggtagacgtagtattagaacacggcggatgtgtgaccacaatggctaaaaataaaccaactctagatatagaattacaaaaaacagaagcaacccaattggcaactttaaggaaactatgtatagaaggaaaaattacaaatataacaactgatagcaggtgtccaacccaaggagaagccacactaccagaagaacaagatcaaaattatgtatgtaaacacacatatgttgatagaggttggggaaatggatgtggattatttggaaaaggaagtttagtaacgtgcgctaaattccaatgccttgaacccatagaaggtaaagtggttcaatatgagaatttaaaatatacggtaattataaccgtacatacaggagatcagcatcaagtaggcaacgaaacacaaggggttacagcagagataacaccacaagcatcaacaacagaagcaatattaccagaatacggaacactaggcctagaatgcagtccaagaacaggattagactttaacgaaatgatactactaacaatgaaaaataaagcatggatggtccatagacagtggttcttcgacttaccccttccatggacgagtggagccaccaccgaaactccaacttggaatagaaaagaactactagtaacattcaaaaatgcacatgcaaaaaaacaagaagttgttgtattaggctcacaagaaggagcaatgagaaccgcactaacaggtgcaacagaaatacaaaattctggaggaacatcaatattcgcagggcatctgaaatgtagactgaaaatggacaaattagaattaaagggaatgagctatgcaatgtgtacaaacacattcgtgttaaaaaaggaagtaagtgaaacgcaacatgggactatattaataaaagtagaatataaaggagaagacgtaccatgtaaaataccatttagcacagaagatggacaaggaaaagcacataacggacgtttaataactgcaaatccggttgtcacaaaaaaagaagaacctgtaaacatagaagcggaaccgccatttggggaaagtaatattgttatcggcataggagataatgcgctaaaaataaactggtacaaaaaaggatcctcaataggaaaaatgttcgaagcaacagcaagaggagcaagaagaatggctatattaggagataccgcatgggattttggaagtgtaggaggagtactaaattcactaggaaaaatggtacatcaaatctttggaagcgcgtatacagcattatttagtggagtaagttgggtaatgaaaataggtataggcgtgttattaacatggataggtttaaatagcaaaaatacctcaatgagtttcagctgtatagctataggtataataactttgtatttaggtgcagtagtacaagcataa

SEQ ID NO: 2308 - RNA, 2037 nt, synthetic construct
  misc_feature 1..2037: note = derived and/or modified CDS sequence (opt6) from DENV-3 Consensus__SSopt-prME(A265T)
  source 1..2037: mol_type = other RNA
atgaaaagaaagaaaacttcattatgcctaatgatgatacttcctgctgcattagcgttccatctaacatcaagagatggagaaccaagaatgatagtaggcaaaaacgaaagaggaaaatccttgctttttaaaacggcaagcggaataaacatgtgtacactaatagccatggatttaggagaaatgtgtgacgataccgttacatataaatgtccacatatcactgaagtagaaccagaagatatagattgttggtgcaatttaacgagcacatgggtaacctacggaacctgtaaccaagccggcgaacaccggagagacaaaagatcagtagctctggcaccacacgtaggtatgggattagacacaagaacgcaaacatggatgtcagcggaaggcgcctggagacaggtagaaaaagtagaaacatgggcactaagacatccgggcttcaccatattagcactatttttagcacattacataggtacttcactaacacaaaaagtagtgatatttatactacttatgttagtaacaccaagcatgacaatgagatgcgtaggagttggtaatagagactttgttgaaggactatcaggagcaacttgggtagatgtagtattagaacatggaggctgtgtgacaacaatggcgaaaaataaaccaacactagatatagaattacagaaaacagaagcaacgcaattagcaacgctgagaaaactatgtatagaaggaaaaataacgaacataacaacagactcacgatgtccaacccaaggagaagcaacattaccagaagaacaagaccaaaactatgtatgcaaacatacgtacgtagataggggttggggtaacggttgtggactatttggaaaaggaagtttggtaacatgtgctaaatttcaatgtttagaaccaattgaaggtaaagtagtacaatatgaaaatctcaaatatactgtaataataactgtacacactggtgatcaacaccaagtaggaaatgaaacacaaggagtaactgctgaaattacaccacaagcaagtacaacagaagcaatactcccagaatatggaacattgggattagaatgttccccaagaacaggcttggacttcaatgaaatgatacttttaacaatgaaaaataaagcgtggatggtccatcgacaatggttctttgacctcccattgccatggacaagtggtgcgacaacagagacaccgacctggaacagaaaagaactattagtaacattcaaaaatgcacacgctaagaaacaagaggtagttgtactaggcagtcaagaaggagcaatgcataccgccttaactggcacaactgaaattcaaaatagtggaggaacgagtatatttgcaggtcatctaaaatgtagactcaaaatggataaactcgaactaaaaggaatgtcatacgcaatgtgcacaaatacttttgtactaaagaaagaggtaagtgaaacacaacatgggacaatactaataaaagtagaatacaaaggtgaagacgtcccatgtaaaataccatttagcacggaagacggccaaggaaaagcacataacggtagattaataactgctaatccagttgtaaccaagaaagaagaacccgtaaatattgaagctgaacctccctttggcgaatcaaatattgtaataggtataggagataatgctctaaaaatcaattggtataagaaaggaagctcaataggaaaaatgtttgaagcaacagcacgaggagcaagaagaatggcaatactaggagatactgcatgggactttggatcagtaggtggagtcttaaactccttaggtaaaatggttcaccaaatattcggaagcgcatatacagcattattctcaggagtatcatgggtaatgaaaataggaataggcgtattactcacatggataggacttaatagcaaaaatacatcaatgtcattttcctgtatagcaataggaataataactttatacttaggggctgtcgtacaagcatag

SEQ ID NO: 2309 - RNA, 2037 nt, synthetic construct
  misc_feature 1..2037: note = derived and/or modified CDS sequence (opt6) from DENV-3 Consensus__SSopt-prME(S296G)
  source 1..2037: mol_type = other RNA
atgaaacgtaaaaaaacaagtttatgcttgatgatgatattaccagcagcattagcattccacttaacctcaagagatggagagccaagaatgatagtaggtaaaaatgaaaggggcaaaagcttgttatttaaaacagctagtggaataaatatgtgcacattaatagcaatggacctaggagaaatgtgtgatgatacagtgacctacaaatgtccacacataacagaagtagaaccagaagatatagattgttggtgtaacttaactagtacatgggtaacatacggcacatgcaaccaagcaggagaacacagaagagataaaagatcagtagcattggcacctcatgtaggaatgggattagatacaaggacacaaacatggatgagtgcagaaggagcttggagacaagtagagaaagtagaaacatgggcactaagacatccaggatttaccattttagcgctattcttagcacactacattggcacatcactaacacaaaaagttgtcatatttatactactaatgttagtaacaccaagcatgacaatgagatgtgtaggagtaggaaatcgagatttcgttgaaggattaagcggagctacgtgggttgatgtagtactagaacatggaggttgcgtaacaacaatggcaaaaaacaaacccacattagacatagaactacagaaaacagaagcaacacaattagctacattaagaaaattatgcattgagggtaaaattacaaatataacaactgatagcagatgcccaacacagggagaagcaacactacctgaagaacaagaccaaaattacgtatgcaaacacacatacgttgatcgaggttggggaaatggatgcggattatttggaaaaggaagtttagtaacatgcgcaaaattccaatgcttagaaccaatagaagggaaagtagtccaatatgaaaatctgaaatatacagtaataataacagtacacacaggagaccaacatcaagtaggcaacgaaacacaaggagttacagcagaaataacaccacaagcctcaacaacagaagcaatacttcctgaatacggaactctaggattagaatgctcacctagaacaggactcgacttcaacgaaatgatacttctgacaatgaaaaacaaagcatggatggtccaccgacagtggttcttcgatttaccactaccatggacatcaggtgccacaactgaaacaccaacgtggaatagaaaagaacttttagttacattcaagaacgcacatgcaaaaaaacaagaagtagtagtactaggatcacaagaaggggcaatgcatacagctttaacaggagcaactgaaatacaaaattcaggaggaacaagtatattcgcaggtcatctaaaatgcagattaaaaatggataaattagaacttaagggaatgggatatgcaatgtgcacaaacacatttgtgttaaaaaaagaagtttcggaaactcaacacggaacaatactaataaaagtagaatataaaggtgaagatgtaccatgcaaaataccatttagtaccgaagatggtcaaggaaaagcacacaatgggagattaatcacagcaaatcctgttgtaacgaaaaaagaagaaccagtaaatatagaagcagaaccacccttcggagaaagcaatatagtaataggaatcggagacaatgctttaaaaataaattggtataaaaaaggttcatcaatcggaaaaatgttcgaggccacagcccggggagccagaagaatggcaatcctaggagacacagcttgggatttcggaagcgtaggtggagtactaaatagtctaggaaaaatggtacatcaaatattcgggagtgcatacaccgctttgtttagcggagtaagttgggtaatgaaaataggtataggcgtacttttaacatggatagggcttaactcaaagaacacaagcatgagttttagttgcatagccattggaataataacgctatacttgggtgcagtcgtacaagcataa

SEQ ID NO: 2310 - RNA, 2037 nt, synthetic construct
  misc_feature 1..2037: note = derived and/or modified CDS sequence (opt6) from DENV-3 Consensus__SSopt-prME(S311R)
  source 1..2037: mol_type = other RNA
atgaaaagaaaaaaaacaagtttgtgtttaatgatgattctaccagcagccttagcatttcacttgacatcaagagatggagaaccaagaatgatagtaggaaaaaatgaaaggggcaagagcctcttatttaaaacagctagcggaataaacatgtgtacattaatagcaatggacttgggtgagatgtgcgatgatacagtaacatataaatgtccacatattacagaagtagaaccagaagacatagattgttggtgcaatttaactagtacatgggtgacctatggcacttgcaatcaagcaggcgagcatagacgagataaaaggtcagtggcattagccccacacgtgggaatgggacttgacacaagaacgcaaacatggatgagtgcagaaggggcatggcgccaagtagaaaaagttgaaacatgggcattaagacatccaggatttacaattttagcattatttttagcacattatataggaactagcttaacacaaaaagttgtaatattcatactcttaatgttagttacaccgagcatgaccatgcgatgtgtaggagtagggaacagagattttgtagaaggacttagtggagcaacatgggtagatgtagtactggaacacggaggttgtgtgacaacaatggcaaaaaacaaaccaacactagacattgaactgcaaaaaacagaagccactcaattagcaactctaagaaaactgtgtattgaaggaaaaataaccaatattacaactgattcaaggtgccctacacaaggagaagcaactctaccagaagagcaagatcaaaattatgtatgcaaacatacgtacgtagataggggatggggaaatgggtgtggactatttggaaaaggaagtttggtcacatgtgcaaaatttcagtgcctggagcctatagaaggtaaagtagtccaatatgaaaacttaaaatatacggtcatcataacagttcacacaggggatcaacatcaagtaggaaacgagacacaaggtgtaacagcagaaataacaccacaagcatccacaacagaagcaatactaccagaatacggaacgttaggcttagaatgttcccctagaacaggtctagatttcaatgaaatgatactattaacgatgaaaaataaagcttggatggtacataggcagtggttttttgacctcccacttccatggacaagtggtgctacaacagaaacaccaacttggaacagaaaagaattattagttacttttaaaaacgcacatgcaaaaaaacaggaagtagtagtcttaggctcacaagaaggagctatgcatacagcattaacaggagcaaccgaaatacagaattcaggcggaacaagcatattcgcaggacacctaaaatgtagattgaaaatggataaattagaactaaaaggtatgagttatgcaatgtgtacaaatacatttgtactcaaaaaagaggtaagagaaacccaacatggtacaatactaataaaagtagaatataaaggcgaagatgtaccatgcaaaataccattttcaacggaagatggtcaaggcaaagcacataatggaagattaataacagcaaatcctgtggtaacaaaaaaagaagaaccagtcaatatagaagccgaaccaccattcggcgagagtaacattgtcataggaataggggacaatgctctgaaaataaattggtataaaaaaggaagttcaataggaaaaatgtttgaagcaacagcaagaggagcaagaagaatggccatattaggtgatacagcatgggattttggtagcgtaggaggagttctaaattcactcggaaaaatggtccaccaaatattcggaagtgcatacacagcactattcagtggagtgtcttgggtaatgaaaatagggataggcgtattactaacatggataggactgaacagcaaaaacacgtctatgagttttagctgcattgcaattggaataataacattatacttaggagcagtggtacaagcataa

SEQ ID NO: 2311 - RNA, 2037 nt, synthetic construct
  misc_feature 1..2037: note = derived and/or modified CDS sequence (opt6) from DENV-3 Consensus__SSopt-prME(K321T)
  source 1..2037: mol_type = other RNA
atgaaaagaaaaaaaacttcactatgtctgatgatgatactcccagcagcattggcatttcatttaacatcaagagatggagaaccgagaatgatagttggaaagaatgaaagaggcaaaagtctattatttaaaacagcttcaggaataaacatgtgcacattaatagccatggatctaggagaaatgtgtgacgatacagtgacctataaatgcccccatattacagaagtagaacccgaagatatagattgttggtgtaaccttacaagcacatgggttacatatggcacatgtaatcaagcaggtgaacatagaagagataaaagatcagttgcactggcaccacatgtagggatgggattagatactagaacacagacatggatgagcgcagagggtgcttggcgtcaagtcgaaaaagtagaaacatgggcattaagacatccaggatttacaatactagcattgtttctagcacattacataggaactagcttaacccaaaaagtagtcatatttatattattaatgttagtaactccgagtatgacaatgagatgtgtaggagttggaaacagagactttgtggaaggcctatcaggagcaacatgggtagacgtagtactagaacatggtggatgtgttacaaccatggcaaaaaataaaccaacattagatatagaattacagaaaacagaagctacacaattagcaacattaagaaaactgtgtatagaaggtaaaatcacgaatattacaacagacagtagatgtccaactcaaggagaagctacactaccagaagaacaagatcaaaactacgtatgcaaacacacatacgtagatagaggctggggaaacggctgcggattattcggaaaaggatctttagtaacatgtgctaaattccaatgtctagaaccaatagaaggtaaagtagtacaatatgaaaatctaaaatacactgtaataataacagtacacactggagatcaacaccaagtaggaaatgaaacacaaggcgtcacagcagagatcacacctcaggccagtactacagaagcaatactccctgaatatggaacattaggattagaatgttcaccaagaactggactagatttcaacgagatgattctattaaccatgaaaaataaggcatggatggttcataggcaatggtttttcgatctacctctaccatggacatcgggtgcaacaactgagacccctacatggaacagaaaagaattattagtaacatttaaaaacgctcatgcaaaaaaacaagaagtagtagttctaggaagccaagaaggagcaatgcatacagcactcactggagcaacagaaatacaaaatagcggaggaacatcaatatttgcaggacatttaaaatgcaggttaaagatggataaactagaattgaaaggaatgagctatgctatgtgtaccaacacttttgtattaaaaaaagaagtatcagaaacacaacacggcacaattttaataacagtagaatataaaggagaagatgtaccatgtaaaatacctttcagcacggaagatggacaaggtaaagctcataatggacgactaataacagcaaatccagtagtgacaaaaaaagaagaaccagtaaacatagaagcagaaccaccctttggagaaagtaacatagtgataggaataggtgacaatgctcttaaaataaactggtataaaaaagggtcttcaataggaaagatgtttgaagcaacagctaggggagccaggagaatggcgattctaggtgacacagcatgggactttggaagtgtaggtggggttttaaatagtctaggaaaaatggtacatcagatatttggtagtgcatatacagctctattttccggtgtatcatgggtaatgaaaataggtattggagtattattaacatggataggattaaattcaaaaaacacaagcatgagtttcagctgtatagcaataggaataataactctatatctaggagctgtagtacaagcataa

SEQ ID NO: 2312 - RNA, 2037 nt, synthetic construct
  misc_feature 1..2037: note = derived and/or modified CDS sequence (opt6) from DENV-3 Consensus__SSopt-prME(G28C,H242C)
  source 1..2037: mol_type = other RNA
atgaaacgaaaaaaaacatcactatgtcttatgatgattttacccgcagcattagcatttcacttaacaagtcgagatggagaacctagaatgatagttggaaaaaacgaacgaggaaaaagcttactattcaaaacagcatcaggcataaatatgtgtacactaatagcaatggacttaggcgaaatgtgtgacgatacagtaacctataaatgtcctcacataacagaagtagaaccagaagacatagattgttggtgtaacctcacatcaacatgggtaacatacggtacatgtaaccaagcaggagaacacagaagagacaaaagatcagtagccttagcaccacatgtaggtatgggtttggatacacgtacacaaacgtggatgtctgcggaaggtgcttggcgccaagtagaaaaagtagaaacatgggcactaagacacccaggatttacaatattagcactttttcttgctcactatataggcacatcactaacacaaaaagtagttatatttattttattaatgctagtaacaccaagcatgacaatgagatgtgtaggagtcggaaatagggatttcgtagaaggtctatcaggcgcaacctgggttgatgtagtattagaacactgtggttgcgtaacaacaatggcaaaaaataaaccaacacttgacatagagttacaaaaaacagaagccacacaactagctacattaagaaaattgtgcatagaaggtaaaataactaatatcaccacagatagtagatgtccgacacaaggagaagcaacactacccgaagaacaagatcaaaattacgtatgtaaacacacatatgtagaccgcggatggggaaatggctgtggattattcggtaaaggaagtttagtaacatgcgcaaaattccaatgtctagaaccaatagaaggtaaagtagtacaatatgagaatctaaaatatacagtaataataaccgtacacacaggagaccaacaccaagtaggaaacgaaacgcaaggagttacagcagaaattacgccacaagcctcaacaacagaagcaatacttccagaatatggaacactaggattagaatgtagcccgagaacaggtctggactttaatgaaatgattttattaacaatgaaaaataaagcgtggatggtacatagacaatggttttttgacttacccctaccatggacttcaggagctacaacagaaacacctacatggaacaggaaagaactcttagtaacatttaaaaacgcttgcgcaaaaaaacaagaagtcgttgtcctaggttcccaagaaggagcaatgcatacagcattaacaggagcaaccgaaatacaaaattcaggtggaacttctatttttgccggacacctaaaatgtcgcctgaaaatggacaaacttgaactaaaaggaatgtcatatgccatgtgtacaaacacattcgtactgaaaaaagaagtatcagaaacacaacatggaacaatattaataaaagtcgaatataaaggagaagatgtaccatgtaaaataccattttcaacagaagatggccaaggaaaagcacataacggcagattaattactgcaaatcctgtagttactaaaaaagaagagcccgttaacatagaagcagaaccaccatttggtgaaagtaatatagtgataggaatcggcgataacgcattaaaaataaactggtataaaaaaggaagcagcataggaaaaatgtttgaagcaacagccagaggtgcaagaagaatggcaatattgggtgacacagcctgggactttggttcagtaggaggagttctaaattcattaggaaaaatggtacatcagatatttggttcagcatatacagcactattttcgggagtatcatgggttatgaaaataggaataggtgtactattaacatggattggtttaaactcgaagaatacatcaatgtcattttcatgcatagcaataggtataataactttatatttaggagctgtagttcaggcataa

SEQ ID NO: 2313 - RNA, 2037 nt, synthetic construct
  misc_feature 1..2037: note = derived and/or modified CDS sequence (opt6) from DENV-3 Consensus__SSopt-prME(R186L,A265T)
  source 1..2037: mol_type = other RNA
atgaaaagaaaaaaaactagcttatgtctaatgatgatactacctgcagcactagcctttcatttaacaagtagggacggagaaccaagaatgatagtaggaaaaaatgagagaggaaaaagcttactattcaagactgcaagtggaatcaatatgtgtacactaatcgcaatggatttaggtgaaatgtgcgacgacacagtaacttacaagtgtcctcatataacagaagtagaaccagaagatattgattgttggtgcaacctaacgagtacatgggttacttatggaacatgtaaccaagcaggagaacaccggcgagataaaagatccgtggcactagcaccacatgtaggaatgggcctagatacccgtacacaaacatggatgagtgcggaaggggcgtggagacaagtagaaaaagttgaaacttgggcattacgacacccaggctttactatattagcattatttttagcacattacataggaaccagtttaacgcaaaaagtagtcatatttatattattaatgctagtaacaccaagtatgactatgagatgtgtcggagtaggaaacagagatttcgtagaaggacttagtggagcaacgtgggtagatgttgtactagaacacggtggttgtgtaacaacaatggcaaaaaacaaaccgacgctagacatagaactacaaaaaacagaagccacacaattggcaacattaagaaaattatgtatcgaaggaaaaataacaaatataaccactgattcaagatgtccaacacaaggcgaagcaacgctccccgaagaacaggatcaaaattatgtatgtaaacacacatacgttgaccgcggttggggaaatggatgtggcttgttcggaaaaggttcattagttacttgcgcgaaattccaatgcttagaaccaatagaaggtaaagtagtacaatatgaaaatcttaaatacactgtaataataactgttcataccggagaccaacatcaagtaggaaacgaaactcaaggagtaacagccgaaataacacctcaagccagcacaactgaagcaatattacctgaatatggtactttgggtctagaatgtagtccattaacgggattagactttaacgaaatgattttattgacaatgaaaaataaagcatggatggtacatagacaatggttctttgatttaccgctaccatggacatcaggagctaccacagaaacaccaacatggaacagaaaagaattattagtaacatttaaaaatgcacatgcaaaaaaacaagaagttgttgtattaggctcacaagaaggcgcaatgcatacagcattaacaggaacaacagaaatacagaattcaggaggaaccagtattttcgccggacatttaaaatgtagactaaaaatggataaactcgaactaaaaggaatgtcttatgccatgtgtacaaataccttcgtattaaaaaaagaagtatcagagacacaacatggcacaatactaataaaagtagaatataaaggagaagacgtaccatgtaaaataccctttagtacagaagacggtcaaggaaaagcacataatggtaggttgataacagcaaatccagtcgtaacaaaaaaagaagaaccagtaaatatagaagccgaaccaccctttggtgaaagtaatatagttataggaataggagataatgctttaaaaataaactggtataagaaaggatcatcaataggaaaaatgttcgaagcaacggcaagaggcgcgagaagaatggccattctaggagatacagcttgggactttggatcagttggaggtgtattgaacagtctaggaaaaatggtacatcaaatatttggatcagcatataccgcgttattttcaggagtaagttgggtaatgaaaataggaataggtgtactactaacatggatcggattaaattcaaagaatacaagtatgtccttcagttgtatagcaataggaataataacactatatttaggagcagtagttcaagcataa

SEQ ID NO: 2314 - RNA, 2037 nt, synthetic construct
  misc_feature 1..2037: note = derived and/or modified CDS sequence (opt6) from DENV-3 Consensus__SSopt-pr(D104A)ME(F108S)
  source 1..2037: mol_type = other RNA
atgaaaagaaaaaagacaagcttatgtctaatgatgatattaccagcagccttagcatttcatctaacaagtcgtgacggcgaaccaagaatgatagtaggaaaaaatgaaaggggaaaatcactattatttaaaactgcttcaggcataaatatgtgtacattaattgctatggatctaggagaaatgtgtgacgatacagttacttataagtgtccacatatcacagaagtcgaaccagaagatatagattgttggtgtaacttaactagcacatgggtaacatacggaacatgcaaccaagccggagaacatcgaagggcgaaaaggtccgttgcattagctccccatgtaggaatgggactagacacaagaacacaaacatggatgagtgcagagggtgcctggcgtcaagtagagaaagtagaaacatgggcattaagacacccaggattcacaattctagcactctttctagcccactatattgggacctcattaacacaaaaagtggtaatatttattttactaatgttagtaactccatctatgacaatgagatgcgtaggagtcggaaatagagattttgtagaaggtttaagtggagcaacatgggtagatgtagtactagaacacggtgggtgtgtaacaacgatggctaaaaataaaccaacactagacatagaattacaaaaaacagaagcaacccaactagcaacgttaagaaaattatgtatagaaggaaaaattacaaatataacaacagatagtagatgtcctacacaaggagaagccacacttccagaagaacaagaccaaaattatgtatgcaaacatacatatgtagatagagggtggggaaacggttgcggactctctggaaaaggttcattagttacatgtgcaaaatttcaatgcctggaaccaatagaaggaaaagtagtacaatatgaaaacttaaaatatacagtaataataacagtacatacaggagatcaacaccaagtaggaaatgaaacgcaaggggttacagcagaaataactcctcaggctagcacaaccgaagcaatcttacctgaatatgggactttaggtcttgaatgttcaccaagaactggactagatttcaatgaaatgattctattaacaatgaaaaataaagcttggatggtacatagacaatggttttttgacctaccactaccgtggacgtcgggtgcaacaactgaaacaccaacatggaatagaaaagaactgttagtaacatttaaaaacgcacatgcaaaaaaacaggaagtagtagtactaggatcacaagagggagcgatgcatacagcgctgacaggagctacagaaattcaaaacagtggaggaacatcaatatttgcaggacatttaaaatgtcgactaaaaatggacaaactagaattaaaaggtatgagctacgcaatgtgcacaaatacatttgtattaaaaaaagaggtctcagaaacccaacacggcacaatattaattaaggtcgaatataaaggcgaagatgtaccatgtaaaataccattctctacagaagatggtcaaggaaaagctcataatggacgattaataacagcaaatccagtagtgacaaagaaagaagaacccgtaaatattgaagccgagcctccatttggggaaagcaatatagtgattggaataggagacaacgcattaaaaattaactggtataaaaaaggatcatctatagggaaaatgtttgaagcaacagcaagaggcgcaagaagaatggcgatattaggagatacagcttgggacttcggaagtgtaggaggcgttttgaatagtttaggaaaaatggttcatcaaatatttgggagtgcttatacagcattatttagtggagtcagctgggtaatgaaaatcggaataggagtattattaacatggattggtttaaatagtaaaaatacttcaatgtccttcagttgcattgcaataggaataataacattatacttaggtgcagtagttcaagcataa

SEQ ID NO: 2315 - RNA, 2037 nt, synthetic construct
  misc_feature 1..2037: note = derived and/or modified CDS sequence (opt6) from DENV-3 Consensus__SSopt-pr(D104A)ME(R186L,A265T)
  source 1..2037: mol_type = other RNA
atgaaaagaaagaaaacaagtttatgcctgatgatgatactaccagcagcattagcatttcacttaacctcacgagatggagaaccaagaatgatagtaggtaaaaatgaaagaggaaaatccttattatttaaaacagcatcaggaataaatatgtgcacactaatagcaatggatttaggagagatgtgtgacgatacagtaacttacaaatgtcctcacataactgaagtggaaccagaagacatagattgctggtgtaatctaacaagcacatgggtgacatatggaacatgcaatcaagcgggtgaacatcgacgtgcaaaaagatcagtagcattagcacctcacgttggtatgggattagacacaagaacgcaaacatggatgtcagcagaaggagcatggagacaagtagaaaaagtagaaacatgggcattaagacatccaggatttacaatattagctctatttttagcgcattatataggaacctcattgacacaaaaagtcgttatttttatattgttaatgttagttacaccaagtatgactatgcgatgtgtaggtgtaggaaatagagacttcgtcgaaggattaagtggcgctacatgggtggatgtagtactagaacatggaggatgcgtaacaacaatggctaaaaataaaccaaccctagacatagaattacagaaaactgaagcaacacaactggcaactttaagaaaattatgcatagaaggaaaaattacaaatattacaacagatagcagatgcccaactcaaggcgaggcaacgcttccagaagaacaagatcaaaactatgtgtgtaaacatacatatgtagatagaggatggggtaatggatgcggattatttggaaaaggaagtttagtaacatgtgctaaatttcaatgcttagaaccaatagaagggaaagtagtacaatatgaaaatttaaaatacacagtaataattaccgtacatacaggtgatcaacatcaagtaggaaatgaaactcaaggagtgacagcagaaatcacaccacaagcatcgaccacagaagcaatactgcctgaatatggaacattgggactagaatgtagtcctctaacaggtttggattttaacgaaatgatactattaacaatgaaaaataaagcatggatggtacatagacaatggtttttcgacctaccgcttccatggacatcaggagctacaactgaaactccaacatggaatagaaaagaacttcttgtaacatttaaaaatgctcatgctaagaaacaagaagtagtagtattaggaagtcaagaaggagcgatgcatactgcattgacaggaacaactgagatacaaaactcagggggaacgtcaatatttgcagggcacttaaaatgtagattaaaaatggataaactcgaattaaaagggatgagttacgcaatgtgtacaaatacattcgtattaaagaaagaagtatcggaaactcaacatggaacaatactgatcaaagtagaatataaaggtgaagacgtaccttgcaaaattccatttagcacagaagatggccaaggaaaagctcacaatggcagattgattacagcaaaccccgtagtcacaaagaaagaagaaccagtaaatatagaagcagagccaccatttggagaatctaacattgtaattggaattggagataatgctttaaaaataaattggtataagaaaggaagttcaataggaaaaatgttcgaagcaacagcaagaggagcacgcagaatggcaatattaggagacactgcatgggatttcggatcagtaggcggagtattaaacagtttaggaaaaatggttcatcaaatatttggaagcgcatatacagcattattttcaggagtatcatgggtaatgaaaataggaattggagtactattaacatggataggactcaatagcaaaaacacaagcatgtcatttagttgtatagctataggcataataactctatatctaggtgcagtggtacaggcttga

SEQ ID NO: 2316 - RNA, 2037 nt, synthetic construct
  misc_feature 1..2037: note = derived and/or modified CDS sequence (opt6) from DENV-3 Consensus__SSopt-pr(D104A)ME(F108S,R186L,A265T)
  source 1..2037: mol_type = other RNA
atgaaacgtaaaaaaacttcattatgtctaatgatgatattaccagcagcattagcgttccatctaacatcacgcgacggagaaccaagaatgatcgtaggtaaaaatgaacgaggtaaaagtctattatttaaaacagcatcgggtataaatatgtgcacactaatagctatggatttaggagagatgtgcgatgacactgtgacttacaaatgtccccacatcacggaagtagaacccgaagacatagactgttggtgtaacttaacgtcaacatgggtaacctacggaacctgtaaccaagccggagaacataggagagcaaaaagatcagtagctttagcaccacatgtaggaatgggtcttgatacgcgtactcaaacatggatgtcagcagaaggagcatggagacaagttgaaaaagtcgaaacatgggcgttgagacatccaggatttacaatattagcactcttcctagcacattatataggaacaagcctaacacaaaaagttgtaatattcatattattaatgctcgtgacaccaagcatgacaatgagatgtgttggagtcggaaacagagattttgttgaaggcctatctggagcaacatgggtagatgtggtacttgaacatggtggatgcgtaaccaccatggcgaaaaataaaccaactttagacatagaactacaaaaaacagaagcaacacaacttgcaacattaagaaaattatgcattgaaggtaaaataactaatattacaacagacagtagatgcccaacccaaggagaagctactcttccagaagaacaagatcaaaattatgtatgcaaacatacatacgtagatagaggttggggaaatggctgtggtttatcaggtaaaggatcattggtaacttgtgcaaaatttcaatgtctagaacccatagaaggaaaagtcgtccaatatgaaaacttaaaatatacagtaattataactgtacatacaggcgaccaacatcaagtaggtaatgaaactcaaggagttaccgccgaaataacaccacaagcaagcacaactgaggcaatattgccagaatatggaacgttaggtttagaatgtagtccactaacaggattagactttaatgaaatgatattattaacaatgaaaaataaagcatggatggttcatagacaatggttttttgatctaccattaccatggacctcaggagccacaacagaaacaccaacatggaaccggaaagaactgttagtaacttttaaaaatgcgcatgcaaaaaaacaagaagtcgtagttttaggaagtcaagaaggagcaatgcatacagcccttactggaacaacagaaatacaaaattcaggtgggacatcaattttcgcaggtcatctaaaatgtagattaaaaatggacaaattagaacttaaagggatgtcttacgcaatgtgtacaaatacttttgtactcaaaaaagaagtatcagaaacacaacatggcacaatattaattaaagttgaatataaaggagaagacgtaccatgcaaaattcctttcagtacagaagacggacaaggtaaagcacataatggacgactaataacagcaaacccagtagtaacaaaaaaagaagaaccagtaaacatagaagcagaaccaccttttggagagtcaaatatcgtaataggaatcggagataacgcattaaaaataaattggtataaaaaaggatcttcaatcggaaaaatgtttgaagcaacagccagaggcgccagaaggatggcaatattaggtgatactgcatgggatttcggtagtgtaggaggagtattaaacagtctgggaaagatggttcatcagatattcggatcagcatatacagcattattttcgggtgtaagttgggtaatgaaaataggcataggagtactcttaacttggatcggattaaatagtaaaaataccagtatgtcttttagctgtatagcaataggaataattaccctatatctaggagcagtagtacaagcataa

SEQ ID NO: 2317 - RNA, 2016 nt, synthetic construct
  misc_feature 1..2016: note = derived and/or modified CDS sequence (opt6) from DENV-3 Consensus__SSopt-prMEdel101-107,(R99P,F108N)
  source 1..2016: mol_type = other RNA
atgaaaagaaagaaaacatcattatgtctaatgatgatattaccggccgcattagcatttcacttaacatcaagagatggagaacctagaatgatagtaggtaaaaatgaaagaggaaaatcacttttatttaaaacagcatcaggaattaacatgtgcacactaatagcaatggacttaggagaaatgtgtgatgatactgttacatataaatgtccccatataacagaagtggaaccagaagatatagattgttggtgtaatctaacgagtacctgggttacctacggcacatgcaaccaagctggagaacatcggagagataaaagaagcgtagccttagcaccgcacgttggaatgggattagatacaaggacacaaacatggatgtcagcagaaggagcatggagacaagtcgagaaagttgaaacatgggcactacgacatccaggatttacgatattagcactatttctagcacactatattggaacaagtctaacacaaaaagtagtaatatttatactattaatgctagtgactccatcaatgactatgagatgcgttggagtaggaaatagagattttgtagaaggattatccggagccacatgggtagacgtggtactagaacatggtggatgtgtaacaactatggctaaaaataaacctacattagatatagaattacaaaagactgaagcaacacaattagcaacattaagaaaattatgcatagaaggaaagataaccaacataacaacagattctagatgcccaacacaaggagaagcaacattaccagaagaacaagaccaaaactatgtatgtaaacatacatatgttgacccaggaaacggaaaaggatctctagtaacatgtgcaaaatttcaatgtctagaaccaattgaaggaaaagtagttcaatatgaaaacttaaaatatacagttataataacagtacacacaggcgatcaacatcaagtaggcaatgaaacacaaggcgtaacggcagaaatcactcctcaagcatccacaacagaagcaatattacctgagtatggaacattgggtctagaatgttcaccaagaacgggacttgatttcaatgaaatgattctattaacaatgaaaaataaagcttggatggtgcatagacaatggttctttgacctaccattgccctggacatccggagctacaacagaaacaccaacatggaatagaaaagaactattagtaaccttcaaaaacgcccatgccaaaaaacaagaagttgtcgtgctaggatcacaagaaggtgcaatgcacactgcattaacaggagcgacggaaatacaaaactcaggaggaacctcaatatttgcaggtcatctaaaatgtagattaaaaatggataaattagaattaaaagggatgagttacgccatgtgtacaaatacatttgtcctaaaaaaagaagtaagtgaaacacaacatggaactatattgataaaagtagaatataaaggtgaagatgtaccatgtaaaataccattctcaacagaagatggacaaggtaaagcccataatggacgcttaattacagcaaaccctgtcgtaacaaaaaaagaagaacccgttaacatagaagcagaacctccatttggagaatctaacatagtcattggaataggagataacgcactcaaaataaattggtataaaaaaggttcgtcaattggcaaaatgttcgaggctacggccagaggtgcacgtagaatggcaatattaggagatacagcatgggatttcggaagtgttggaggagtattaaatagtctaggaaagatggtacaccaaatatttggatcagcatacacagcattattttcgggagtatcatgggtaatgaaaataggaataggagtcttactcacatggataggattaaattcaaaaaatacctcaatgtcattttcatgtattgcaataggaatcataacactgtacttaggagccgttgtgcaagcataa

SEQ ID NO: 2318 - RNA, 2037 nt, synthetic construct
  misc_feature 1..2037: note = derived and/or modified CDS sequence (opt6) from DENV-3 Consensus__SSopt-prMEdelstem_TM-JEV
  source 1..2037: mol_type = other RNA
atgaaacgtaaaaaaacaagtctatgtctaatgatgatactgccagcagctttggcctttcatctaacttcgagggacggagaaccccgaatgatagttggaaaaaacgaaagaggaaaaagtttattattcaaaacagcctcaggtattaatatgtgtacactaatagcaatggacctaggcgaaatgtgcgacgatacagtaacctataaatgtccacatataacagaagtagaaccagaagacatagattgttggtgtaatttaacaagtacatgggtaacatatggtacctgtaatcaagcaggagaacacagacgagataagagaagtgtagcactagcaccccatgtaggaatgggattagacacaagaacacaaacctggatgagcgcggaaggtgcatggagacaagtcgaaaaagtagaaacatgggcactccgacacccaggttttacgatactagcattgtttcttgctcattatataggaacctcacttacacaaaaagtagtaatatttatattactaatgctggtaacacctagtatgacaatgagatgtgtaggtgtaggaaatcgcgatttcgtagaaggtttgtcaggagctacatgggtagatgtagttttagaacatggcggatgtgtaacaacgatggccaaaaataaacccacattagatattgaactacaaaagacagaagcaacacaattagcaacattaagaaaactatgtatagaaggaaaaataacaaatataacaacagatagtagatgcccaacacaaggagaagcaacattacccgaagaacaagatcaaaactacgtttgcaaacacacatacgtagatagaggatggggcaatggatgcggcctatttggtaaaggatcattagtaacttgtgcaaaatttcaatgtttagaaccaatagaaggaaaggtagtacagtacgaaaatttaaaatatacagtaattataacagtacatacaggtgatcaacatcaagtaggcaacgaaacacaaggagtaactgcagaaattacaccccaagcttcaacaacagaagcaatactacctgaatatggaactttaggactagaatgcagcccaagaacaggtttagattttaatgaaatgatattattaacaatgaaaaataaagcatggatggtacatcgacaatggttttttgatttaccattaccatggacaagcggagctactacagaaactccaacttggaatagaaaagaactactagtaacgtttaagaatgcacacgcaaaaaaacaagaagttgtcgtactaggctcacaagaaggtgcaatgcacacagcattaacaggtgctactgaaatacaaaattcaggcggaaccagtatattcgcaggacatttaaaatgtcggctgaaaatggataaactcgagttaaaagggatgtcatacgcaatgtgtacaaatacattcgtattaaaaaaagaagttagtgagacacaacatggtacaatattaattaaagttgaatataaaggggaagacgtgccctgtaaaattccatttagtactgaagacggtcagggcaaagcacacaatggcagactaatcacagcaaatccagtagttacaaaaaaagaagaaccagtaaatatagaagcagaacctccatttggagaaagcaacatagttataggcataggagataacgctctaaaaataaattggtataaaaaaggtagtacattaggtaaagcattttctacaactttaaaaggagcacaaagactagcggcattaggagatacagcttgggattttggaagtataggaggtgtatttaatagtattgggagagcagtacatcaagtgtttggtggagcgttcagaacattatttggaggcatgagctggatcacccaggggcttatgggagccctattattatggatgggagttaatgccagagacagatcaatagcattagcatttctagcaactggaggtgtcttagtttttctggctacaaatgtacacgcataa

SEQ ID NO: 2319 - RNA, 2037 nt, synthetic construct
  misc_feature 1..2037: note = derived and/or modified CDS sequence (opt6) from DENV-3 Consensus__SSopt-pr(D104A)MEdelstem_TM,(F108S)-JEV
  source 1..2037: mol_type = other RNA
atgaaaagaaaaaaaacaagtttatgcttgatgatgattttacccgcagcattggctttccatttaacctcgagagatggcgaacccaggatgattgtcggaaaaaacgaaagaggaaaaagcctactatttaaaacagcatcaggcataaatatgtgtactcttattgcaatggatctaggagaaatgtgtgatgacactgtaacatataaatgcccacatataacggaagtagaaccagaagatattgactgctggtgcaatttaacatcaacatgggtaacatatggaacatgtaatcaagcaggagaacatagaagagcaaaaagaagtgtagcattagccccacacgtaggcatgggactagatacaagaacacaaacttggatgagtgcagaaggggcatggaggcaagtagaaaaagtcgaaacatgggcattgagacacccaggatttactatattagcgctatttttagctcattatattggcacatcattaacacaaaaagtagtgatattcatattattaatgctagtaaccccatcaatgacaatgagatgtgtcggagtaggtaatagggattttgtggaaggattaagcggtgcaacctgggtagacgttgttttagaacatggaggttgtgtgacaacaatggccaaaaataaaccaaccttagatatagaactacaaaaaacagaagcaacacaactcgccacattaaggaaactatgcatcgaaggaaaaataaccaacataacaactgattcaagatgcccaacacaaggagaagcaactctcccagaagaacaagaccaaaattacgtatgcaaacatacatatgtagatagaggatggggaaatggatgtggactgagcggaaaaggatcattagtaacatgtgcaaaattccaatgtctagaaccaatcgaaggaaaagtagtccagtatgaaaacttaaaatatacagtaataataactgtgcatacaggtgatcaacatcaagtaggcaatgaaacgcaaggagtaacagcggaaataacacctcaagcatcaacaacagaagcaatactaccagaatacggaacacttggattagaatgttctccaagaacaggattagatttcaacgagatgatactattaacaatgaaaaataaagcatggatggttcacagacaatggttctttgatctaccgctaccatggacaagtggggcaacaacagaaaccccaacatggaatagaaaagaacttttggtaacttttaaaaacgcacatgcaaaaaaacaagaagttgtagtattaggaagtcaagaaggagccatgcacacagcattaactggagcaacagaaatacaaaactcaggtggaacatcaatatttgcaggacatctaaaatgtaggctaaaaatggacaaattagaattaaaagggatgagctatgcaatgtgcacaaatactttcgtactaaaaaaagaagtttcagaaacacaacacggaacaatattaataaaagtagaatataaaggagaagacgtcccatgtaaaatacctttctctaccgaagacggacaaggcaaagcacataacggtagacttattaccgctaatccagtagtcacaaaaaaagaagaaccagtcaacatagaagcagaaccaccatttggtgaatcaaatatcgttataggaataggagataacgcactaaaaattaactggtacaaaaaaggttctacattaggaaaagcgtttagtactacattaaaaggagcccaacgattagcagcattaggcgacaccgcttgggattttggttcaattggtggtgtatttaactcaataggccgtgcagtacatcaagtattcggaggagcatttaggacattattcggtggaatgagttggattacacaaggattaatgggagcattattactatggatgggagtaaatgcaagagacaggagcatagcactagcatttttagcaacaggaggagtattagtattcttagctacaaacgtacacgcttaa

SEQ ID NO: 2320 - RNA, 2037 nt, synthetic construct
  misc_feature 1..2037: note = derived and/or modified CDS sequence (opt6) from DENV-3 Consensus__SSopt-pr(D104A)MEdelstem_TM,(R186L,A265T)-JEV
  source 1..2037: mol_type = other RNA
atgaaaagaaaaaaaacctccctatgtttaatgatgatattgcctgctgcattagctttccacctaacaagtagagatggagaaccgcgcatgatcgtaggaaaaaatgagcgaggtaaatcattattatttaaaacagcttcaggaataaacatgtgtacactcatagcaatggacttaggagaaatgtgtgacgatacagtaacatacaaatgtccacatataacagaagttgaaccggaagatatagattgttggtgcaatcttacatcaacatgggtaacttatggcacgtgtaatcaagcaggagaacatcgaagagcaaaaagatctgtagccttagcgccacacgtaggcatgggattagacactagaacacaaacatggatgtcagccgaaggtgcatggagacaggtagaaaaagtagaaacgtgggcacttagacatccagggtttacaatactagcactatttctagcacactatattggaacatcattaacacaaaaagtagtaattttcatattattaatgttggtaactcctagcatgaccatgagatgcgtaggagtaggaaatagagactttgtagaaggtctgagtggagcaacatgggtagacgtggtactggaacatggaggatgcgtaaccaccatggcaaaaaacaaaccaaccctagacatagaactacaaaagacagaagcaacacaattagcaacattaagaaaattatgtattgaaggaaaaataaccaatataacaacagacagtaggtgtccaacacaaggagaagcaactcttcccgaagaacaagatcaaaattacgtttgtaaacacacgtacgtcgatagaggatggggtaatggatgtggattatttggaaaaggatcattagttacgtgcgcaaaattccaatgtttagaaccaatagaaggaaaggtcgtacaatatgaaaatttaaaatatacagtaataataactgtacatacaggagaccaacatcaagtaggcaacgaaacacaaggagtaacagcagaaataacacctcaagcctcaacaacagaagctatattaccagaatacggaacactaggactagaatgtagtcctctaacgggcttagattttaacgaaatgatacttttaacaatgaaaaacaaagcatggatggttcatagacaatggttttttgacttaccactaccttggacaagtggagcaacaacagaaacacccacttggaatcgaaaagaactattggtaacatttaaaaacgcccacgcaaaaaaacaagaggtagtagttttaggttcacaagaaggagctatgcacacagcgctaactggaacaacagaaattcaaaattcaggtggaacaagtatttttgcaggacatcttaagtgtagattaaaaatggataaattagaacttaaaggtatgtcatatgcaatgtgtacgaatacatttgtactaaaaaaagaagtaagtgaaacacaacacggaactattctaatcaaagtagaatataaaggcgaagatgtaccctgcaaaattccattttcaacagaagatggccaaggcaaagcacataacgggcgattaattacagcaaatcctgttgttacaaaaaaagaagaaccagtaaatatagaagcagaaccaccattcggtgagagtaacatagtaataggaataggagacaacgctctaaaaataaattggtataaaaaaggatcaacacttggaaaagcattttcaacaacattaaaaggcgcacaaagattagcagctttgggagatacagcatgggactttggatccataggaggtgtatttaattcaattggaagagcagttcatcaagtatttggaggagcatttcgaacattattcgggggcatgagctggataacacaaggtctaatgggagcattattactctggatgggagtaaacgctagagatagatcaatagccctagcatttttggccacaggaggcgtactagtattccttgcaaccaatgtgcatgcgtaa

SEQ ID NO: 2321 - RNA, 2037 nt, synthetic construct
  misc_feature 1..2037: note = derived and/or modified CDS sequence (opt6) from DENV-3 Consensus__SSopt-pr(D104A)MEdelstem_TM,(F108S,R186L,A265T)- JEV
  source 1..2037: mol_type = other RNA
atgaaacgaaaaaaaacaagtctatgcttaatgatgatactaccagcagcgctagcatttcatttaacatccagagatggagaaccaagaatgatcgtcgggaaaaacgaaagaggaaagtccctactatttaaaacagcaagtggaattaatatgtgtactttaatagcaatggacttgggagagatgtgtgatgacacagtgacatataagtgtccacatataacagaagtagaaccagaagatatagactgttggtgcaatctcacatcaacctgggtaacatatggaacatgcaatcaagcaggtgaacatcgaagagctaaaagaagtgtagcactggcaccacatgtaggtatgggactagacacaagaacgcaaacgtggatgagtgcagaaggagcctggagacaagttgaaaaagttgaaacttgggcacttagacatcctggattcactatattggcactatttctagcacactatataggaacatcacttacacaaaaagttgtaatattcatcttactaatgttggtcacaccgagcatgactatgagatgtgtaggcgttggaaatcgagattttgtcgaaggtttaagtggagctacatgggtagacgtagtattagaacatggaggatgtgtaacaacgatggcaaaaaacaaaccaacactcgacattgaactacaaaaaactgaagcaacacaactagcaacactaagaaaattatgcatagaaggaaaaataaccaatataactacagattcaagatgtcctacacaaggagaagcaactctaccagaagaacaagatcaaaattatgtatgtaaacacacatatgtagatagaggatggggtaatggatgtggactaagtggcaaaggatcattagtaacatgcgccaaatttcaatgtctcgaaccaattgaaggaaaagtggtacaatatgaaaatcttaaatatacagtaattataacagtgcatacgggggatcaacatcaagtaggcaatgaaacacaaggtgtaacagcagaaataacaccacaagcttcaacaactgaagcaatattgccagaatatggaacactaggactagaatgctcaccattaacaggattagatttcaacgaaatgatactattaacaatgaaaaataaagcgtggatggtacatagacaatggttctttgacttaccactcccttggacgagtggagccacaaccgaaacaccaacgtggaatagaaaagaacttctagttacatttaaaaatgctcacgctaaaaaacaagaagtagtagtactaggatcgcaagaaggagcaatgcacactgcattaactggtacaactgaaatacaaaatagtggcggaacttcaatatttgcagggcatcttaaatgtagactgaaaatggataaacttgaactcaaaggaatgtcctatgcaatgtgtacaaatacatttgtactaaaaaaagaagttagcgaaacacaacatggaaccatcttaataaaagtagaatacaaaggagaggatgtcccttgtaaaataccattttcaacagaagatggtcaaggaaaagcacacaacggtaggttaattacagcaaatcccgtagtaacaaaaaaagaagaacctgtgaatattgaagccgaaccaccatttggagagtcaaacatagtaataggaatcggagacaatgctttaaaaataaactggtataagaaaggaagtacattaggaaaagcattttcaactacactaaaaggagcacaaagactagcagccctaggagatacagcatgggattttggaagtattggaggagtatttaattcaataggaagagcagtacatcaagtatttggaggagcatttaggaccctatttgggggaatgtcatggattactcaaggcctgatgggagctctattattatggatgggggtaaacgcaagagatagaagcatagcattagcttttcttgcaactggaggagtacttgtattcctagcaactaatgtacatgcataa

SEQ ID NO: 2322 - RNA, 2037 nt, synthetic construct
  misc_feature 1..2037: note = derived and/or modified CDS sequence (opt6) from DENV-3 Consensus__SSopt-prMEdelstem_TM,(H259N)-JEV
  source 1..2037: mol_type = other RNA
atgaagagaaaaaaaacgagtttatgcttaatgatgatattaccagcggcactagcatttcatttaacaagccgagatggggaacctagaatgatagtaggaaaaaatgaaagaggtaagagtttgctatttaaaacagcttcaggtataaatatgtgtactcttatagcaatggatctaggtgagatgtgtgacgatacagtaacttataaatgtccccatatcacagaagtagaacctgaagatatagactgctggtgtaatctgactagtacatgggtaacatacggaacgtgtaatcaagcaggtgaacacaggcgagacaaaagatcagtagcattagctcctcatgtaggaatgggactagacactagaacgcaaacttggatgagtgctgaaggtgcatggagacaagtagaaaaagtagaaacatgggcattaagacatccaggatttacaattttagcactattcttagcgcattatataggaacaagtttaacacaaaaagtagtaatctttatactacttatgctagtaacaccaagtatgacaatgaggtgtgtaggagtaggtaatagagattttgtagaaggattaagtggagcaacatgggtcgacgtagtactagaacacggaggatgcgtaactacaatggcaaaaaacaaaccaacactagatatagagttacaaaaaacagaagcaacacaattagcaacattaagaaaattatgcatcgaaggaaaaataaccaatataactaccgattcgagatgcccaacacaaggagaagctacgttaccagaagaacaagatcaaaactatgtatgcaaacatacatatgtagatagaggttggggcaatggatgtggactatttgggaaaggaagtttagtaacttgtgcgaaatttcaatgtctcgaaccaatagaaggtaaagttgtacaatatgaaaatctgaaatatacagtaatcataacagtgcacacgggagatcagcatcaagtagggaacgaaacacaaggcgttacggctgaaataacaccacaagctagcacaactgaagcaatattacctgaatatggaacattagggctagaatgcagtccacgaacaggattggattttaatgaaatgatattattaacaatgaaaaacaaagcatggatggtccacagacaatggtttttcgatttaccattaccctggacaagtggagcaacaactgaaaccccaacatggaacagaaaagaattattagtaacctttaagaatgcgcatgctaaaaaacaagaagttgtagtattaggaagtcaagaaggcgcaatgaatacagcattaacaggagcaacagagatacaaaactcaggcggtacttcaatatttgcaggacacttaaaatgtagattaaaaatggataaacttgaattaaaaggaatgagctacgccatgtgtaccaacacatttgtattaaaaaaagaagtgagtgaaacacaacatggcacaatcctaataaaggtagaatataaaggagaagatgtaccatgtaaaataccatttagcacagaagatggacaaggaaaagcgcataatggtagattaataacagcaaacccagtagttacgaaaaaagaagaaccagtaaatatagaagcagaaccgccatttggagaaagtaatatagtaatcggtataggagataatgctctaaaaatcaattggtataaaaaaggatccaccttaggaaaagcattttcaacaacgttaaaaggagcacaaagactagcggcactaggcgatacagcatgggatttcggttcaataggaggagtattcaatagtataggaagagcagtacatcaagtatttggaggagcatttagaactttatttggaggtatgagttggataactcaaggattaatgggcgcacttttgctttggatgggggtaaatgcaagagatcgttcaattgctttagccttcttagcgacagggggagtactagtattcctcgctacaaacgtacatgcataa

SEQ ID NO: 2323 - RNA, 2037 nt, synthetic construct
  misc_feature 1..2037: note = derived and/or modified CDS sequence (opt6) from DENV-3 Consensus__SSopt-prMEdelstem_TM,(R186L,A265T)-JEV
  source 1..2037: mol_type = other RNA
atgaaaagaaaaaaaactagtctatgtttaatgatgatattaccagctgctttagcatttcatttaacaagcagggacggagaacctagaatgatagttggaaaaaatgaaaggggaaaatcactactatttaagacagcaagcggaataaatatgtgcacactaatagcaatggatctaggagaaatgtgtgacgatacagtaacctataaatgtcctcacataacagaggtagaaccggaagatatcgattgctggtgcaatctaactagtacctgggtaacatacggaacatgcaatcaagctggcgaacataggagagataaaagatccgtagcactagctccacacgtaggaatgggtctagatacaagaacacaaacatggatgtcagcagaaggcgcatggcgacaagtagaaaaagtagaaacgtgggctcttagacatccgggcttcacgatactggcattattccttgcgcattatatcggaacatcattaacacaaaaagtagtaatattcatactactaatgctagtaactccatcaatgactatgagatgcgtaggcgtagggaatagagactttgtcgagggtttatcaggagcaacatgggttgatgtagtattagaacacggaggttgtgtaactacgatggccaaaaataaacctacattggacatagaattgcaaaaaacagaagcaacacaactagcaactctaagaaaattatgcatagagggtaaaataactaatataacaacagatagtaggtgtccaacacaaggagaagctactttaccggaagaacaagatcaaaattacgtatgcaagcacacgtatgtagatagaggatggggtaacggatgcggactattcggcaaaggaagtttagtaacatgtgcaaaatttcaatgtttggaacctattgaaggtaaagtagtacaatatgaaaatttaaaatacacagtaataataacagtacacacaggtgatcagcatcaagttggaaacgaaacacaaggagttactgcagaaataacaccacaagcatcaactactgaagcaattttacctgaatatggtacattaggactagaatgttcacctctaacaggactagacttcaatgaaatgatactattaactatgaaaaataaagcctggatggtccatagacaatggtttttcgaccttccattaccctggacaagtggcgcgacgacagaaacaccaacttggaatagaaaagaacttttagtaacctttaaaaatgcacatgctaaaaagcaagaagttgtagtattaggttcacaagaaggcgcaatgcatacagcattaacaggaactacggaaatacaaaattcaggcggaacatcaatatttgctggacatctaaaatgtagactaaaaatggacaaattagagctaaaaggtatgtcgtatgcaatgtgcacaaacacctttgtactcaaaaaagaagtatcagaaacacaacacggaacaatattaataaaagtagaatataagggagaagatgttccatgtaaaataccattttcaacagaagacggacaaggaaaagcacacaatggtagattaattacagcaaatccagtagtaactaaaaaagaagaaccagttaacattgaagcagaacctccgtttggagaaagcaacatagtcataggcataggcgataatgcattaaaaataaattggtacaaaaaaggaagtacactaggaaaagcattctcaacaacattgaaaggtgcacaaagactagcagcactaggagacaccgcatgggattttggtagcataggtggagttttcaactcaatcggaagagccgtacaccaagtatttggtggagcatttagaaccctatttggaggtatgtcatggattacgcaaggattaatgggcgccttattattatggatgggtgtaaatgcccgtgacagaagcatagcattagcttttttagccactgggggagtgctagtattcttagctacaaatgtccacgcataa

SEQ ID NO: 2324 - RNA, 2016 nt, synthetic construct
  misc_feature 1..2016: note = derived and/or modified CDS sequence (opt6) from DENV-3 Consensus__SSopt-prMEdelstem_TM,del101-107,(R99P,F108N)-JEV
  source 1..2016: mol_type = other RNA
atgaaaagaaagaaaacttcattatgtctaatgatgatattaccagcggcactagcatttcatttaacaagtagagatggagaaccacgaatgattgtgggtaaaaatgaaagaggaaaatcattattattcaaaacagcatcaggaataaatatgtgtacgctaatagcaatggacctgggagaaatgtgtgatgacacagtaacatataaatgtccacacataacagaagtcgaacctgaagatatagactgttggtgcaatctaacgagtacttgggtaacatatggaacatgcaaccaagcaggagaacacagaagagataaacgatcagttgcactagcaccacatgttggaatgggcttagacacgcgaactcagacatggatgagcgcagaaggcgcatggagacaagtagaaaaagtagaaacatgggccttaagacatcctggattcacaatcctagcactattcttagcgcactacataggaacgtcattaacacaaaaagtcgttatattcattttactaatgcttgtaacaccaagtatgacaatgagatgcgtaggagtcggcaatagagattttgtagaaggtctatccggtgccacatgggtagacgtggtattagaacatggaggatgtgtcacgacaatggccaaaaataaaccaacattagatatagaattacagaaaacagaggcaacacaattagcaacactaagaaaattatgcatagaaggaaaaataactaatataactacagattcaaggtgtcccacacaaggagaagctactttaccagaagaacaagaccaaaactacgtatgtaaacatacttatgtagatccaggtaatggaaaaggatcattagtaacatgtgcaaaatttcaatgcttagaaccaatagaaggcaaagtagtacaatatgaaaatttaaaatacactgtaataataacagtacatactggagatcaacaccaagtaggaaacgaaacacaaggagttacagcagaaataacaccgcaagcctcaactactgaagcaatattaccagaatacggaactctaggattagaatgttccccacgaaccggactggacttcaatgaaatgatattactaacaatgaaaaataaagcatggatggtacacagacaatggttctttgatttacctttaccatggacaagtggagctactacagaaacaccaacatggaatagaaaagaactcctagtaacgtttaaaaatgcacatgcaaagaaacaagaagtagttgtactaggaagccaagaaggggcaatgcatacagcattaacaggagctacagaaattcaaaacagtggtggaacatcaatttttgccggacatctaaaatgtagacttaaaatggataaactcgaactgaaaggaatgtcatacgcaatgtgtactaatacattcgtcttaaagaaagaagtaagtgaaacacaacatggaactatacttattaaagtcgaatataaaggagaagatgtaccatgtaaaatcccttttagtacagaagatggacaaggaaaagcacacaacggaaggttaattacagcaaacccggttgtaacaaagaaagaagaaccagtaaatattgaagcagagccgccttttggagaatctaatatagtaataggcatcggagataatgcgttaaaaataaactggtataagaaaggttcaacattgggtaaagccttttccacaactttaaaaggagcacaaagattggcagctttaggtgatacagcatgggactttggatcaataggaggcgtatttaatagtataggtagagctgtacatcaagtatttggaggagcattcagaacactattcggaggaatgagttggatcacccaaggattaatgggagcacttcttttatggatgggagtaaatgctagagataggtctatagcattagcgtttcttgccacaggaggggtattagtatttctggcgacaaatgtacatgcatga

SEQ ID NO: 2325 - RNA, 3081 nt, synthetic construct
  misc_feature 1..3081: note = derived and/or modified CDS sequence (opt6) from DENV-3 Consensus__SSc-prME-NS1
  source 1..3081: mol_type = other RNA
atgactagcttgtgtctgatgatgatattacctgctgctctagcatttcacttaacaagtagggatggagagcctaggatgatagtaggcaaaaacgaaagaggtaaaagtttattatttaaaacagcttcaggaataaatatgtgcacactaatagcaatggatctaggcgagatgtgtgacgatacagtcacatataaatgcccccacattacagaagttgagccagaagatatagactgttggtgcaacctaacaagtacatgggtaacatatggcacttgtaatcaagctggtgaacacagacgtgacaaaaggagtgttgcattagcaccacacgtaggaatgggactggacacacgaacacaaacgtggatgagtgcagaaggggcatggcgtcaagtcgaaaaagtagaaacgtgggctttaagacatccgggatttacaatattagctttgtttttggcacattatataggaacatctctaacccaaaaggttgtaatatttatattacttatgttagtaacaccgagtatgaccatgagatgtgttggagttggaaacagggatttcgtcgaaggattatcaggagcgacatgggtagacgttgtgcttgaacacggcggatgtgtcacaaccatggctaaaaacaaacccacccttgatatagaattacaaaagacggaagcaacacaactagcaacattacgaaaattatgtatagaaggaaagattaccaatataactaccgatagcagatgtcctacacaaggtgaagctacactacccgaagaacaggaccagaattacgtctgtaaacatacttatgtagatagaggctgggggaatggctgtggcctgtttggaaaaggtagcctggtaacttgcgcaaaattccaatgcttggaaccaatagaagggaaagtagtgcaatatgaaaacttaaaatacactgtaataattacagttcatacaggtgaccaacaccaagtaggtaatgaaacacaaggagtaactgctgaaattacacctcaagcaagcacaacagaagcaatattgccagaatatggaaccctaggtttagagtgctctccaagaacaggattagactttaatgaaatgattttactaactatgaaaaataaagcctggatggtacatcgtcagtggtttttcgacttaccactaccatggacaagcggggctacaacagaaacacccacatggaacagaaaagaattgctagttacgtttaagaatgcgcatgccaagaaacaagaagtagtagtgttaggaagtcaagaaggagcaatgcatacagctctcacaggagcaacagaaatacaaaattcaggtggaacaagtatttttgctggacatttaaaatgccgactaaaaatggacaaactagagctaaaaggtatgagctatgcaatgtgtactaacacgtttgttctcaagaaagaagtatcagaaacacaacatggtacaatcctgatcaaagtagaatataaaggtgaggacgttccctgcaaaattcccttcagcacagaagatggacaaggaaaagctcacaatggaagactaataactgcaaatccagtagtaacgaagaaagaggaacccgtgaacatagaggcagaaccaccatttggcgaaagcaatattgtaataggcataggcgacaatgcgttaaaaataaactggtacaagaaaggatcatcaattggaaaaatgtttgaagcaactgcacgaggagcaagaagaatggccatattaggtgatactgcttgggacttcgggagtgtagggggagttttaaattcgctgggaaaaatggttcatcaaatttttggaagcgcgtatacagcactattttcaggtgtaagttgggtaatgaaaataggtataggggtattactaacctggataggtcttaatagtaaaaatacaagtatgtcattctcatgtatagctataggaataataacattatacctaggagctgtagtacaagcggacatgggatgtgtaataaattggaaaggaaaagaacttaaatgtggatccggaatatttgtaacaaatgaagttcacacctggaccgaacaatataaatttcaagcagattcaccaaaacgcttggcaactgcaatagcaggagcttgggaaaatggagtatgcggaattaggtcgacaaccagaatggaaaatttactatggaaacaaatagcaaatgaattaaattatattctatgggaaaataacataaaattaactgtagtagtgggtgatataataggagtccttgaacaaggaaaaagaacactgacaccacaaccaatggaactaaaatacagctggaaaacatggggaaaggcaaaaatagtcaccgctgaaactcaaaatagtagctttataatagacggtcctaacacacccgaatgtccttcagtctcgagagcctggaatgtatgggaagtcgaagattatggatttggagtattcactactaatatctggttaaaattgagagaagtctacacacaattatgcgaccatagattaatgtctgcagcagttaaagatgaaagagcagttcatgcagatatgggatattggatagaaagtcagaaaaacggttcatggaaattagaaaaagcaagtcttatcgaagtaaaaacatgtacatggcctaaaagtcatacattatggtcaaatggtgtactcgaatcagatatgataataccgaaatcacttgctggcccgataagtcaacataatcatagacctggatatcatacacaaacagcaggaccatggcacttaggaaaactagaactagattttaactactgcgaaggaacaacagtagttataactgaaaattgtggcacaagaggtccttcacttagaacgacaacagtgtcaggaaaactaatacatgagtggtgctgtcgatcatgtacattaccaccattaagatacatgggtgaagatggatgctggtatgggatggaaatacgaccaataagtgaaaaagaggaaaatatggtaaaatcattagtaagtgcgtga

SEQ ID NO: 2326 - RNA, 1824 nt, synthetic construct
  misc_feature 1..1824: note = derived and/or modified CDS sequence (opt6) from DENV-3 Consensus__SSm-EdelTM-linker-ferritin
  source 1..1824: mol_type = other RNA
atgacccaaaaagtcgtcatatttatactactaatgctagtcactccatcaatgacaatgagatgtgttggtgtaggaaacagggatttcgttgaaggacttagcggagcaacctgggtagacgttgtactagaacacggaggatgtgtaacaacaatggcaaaaaacaaaccgactctcgacattgaactacaaaaaactgaagcaacacaattagcaacattaagaaaactatgcatagaaggaaaaataacaaatataacaacagatagcagatgcccaacacaaggagaagctacattacctgaagaacaagatcaaaactatgtgtgcaaacatacttacgtagacagaggatggggcaatggttgcggactattcgggaaaggatctttagtcacttgcgcaaaatttcaatgcctagaacctatagaaggaaaagtcgtacaatacgaaaatttaaaatatactgtaataataacagtacacactggcgatcaacaccaagttggcaacgaaacacaaggagtaactgctgaaatcaccccacaagcatcaacaactgaagcaatattaccagaatacggaacattaggtctagaatgtagcccaagaaccggcctagacttcaatgagatgatattattaactatgaaaaataaagcatggatggtacacagacaatggtttttcgatctccctcttccatggacatcaggtgccacaacagaaacgccaacatggaacagaaaagaactattagtaacattcaaaaatgcccacgcaaaaaaacaagaagtagtcgtcttaggaagccaagagggcgctatgcatacagcgctaacaggagcaactgaaattcaaaacagcggcggaacctcaatatttgcaggccatttaaaatgtagattaaaaatggacaaactagaactaaaaggaatgtcatacgctatgtgtacaaatacatttgtattaaaaaaagaagtctcagaaacccaacatggaacgatactaataaaagtagagtataaaggcgaagatgttccatgtaaaataccattcagcactgaagacggccaaggtaaagcacataatggaagattaataacagcaaatccagttgtaacaaaaaaagaagaaccagttaacattgaagcagaaccaccatttggagaatcaaacatagtaataggaataggtgataatgcactaaaaataaattggtataagaaaggaagctcaataggaaaaatgttcgaagcaacagcacgaggagcacgtcgaatggctatattgggagatacagcgtgggacttcggaagtagtggaggcgatatcatcaaactactaaatgaacaagtaaataaagaaatgcaatcgtcaaacctctatatgtcaatgagcagttggtgttatacacattcattagacggagccggactattcctttttgaccatgcagcagaagaatatgaacacgcaaaaaaactaataatatttcttaatgaaaataacgtaccagtacaattaacaagcataagcgcaccagaacataaatttgaaggacttacacaaatattccaaaaagcatacgagcatgaacaacatatctcagaatcaattaataacatagttgaccacgcaataaaatcaaaagaccatgcaacattcaacttcctacaatggtacgtagcagaacaacacgaagaagaagtactattcaaagatattttagataaaatagaattaataggtaacgaaaatcatggcctatatcttgcagatcaatacgttaaaggaatcgcaaaatctagaaaaagctaa

SEQ ID NO: 2327 - RNA, 1821 nt, synthetic construct
  misc_feature 1..1821: note = derived and/or modified CDS sequence (opt6) from DENV-3 Consensus__SStPA-WHbcAg-linker-EdelTM
  source 1..1821: mol_type = other RNA
atggacgcaatgaaaagaggactatgttgtgtgctattattatgtggagctgtatttgtagatagtgttacaggaatggatattgacccatataaagaatttggttctagctaccaactacttaatttcttacccctagatttctttccagatttaaacgcattagtagatacggcgacagcattatatgaagaagaattaacaggaagagaacactgcagccctcaccatacagcaattagacaagcactagtttgctgggacgaactaacaaaacttatagcatggatgtcatctaatataacttctgaacaagtaagaacaataatagtaaatcacgtaaatgacacatggggactaaaagtaagacaaagtttatggtttcatttatcatgtctgacatttggtcaacacacagtacaagaattcctagtaagctttggagtgtggataagaacaccagcaccatatagaccaccaaacgcaccaatcctatccacattaccagaacataccgtaatatgtggagggggtggatccggaggtggaggaatgcgatgtgtaggagttggaaatagagacttcgtagaaggactatcaggagctacatgggtagatgtagtactagaacacggagggtgtgtaacaacaatggcaaaaaataaaccaacactagacattgaactacaaaaaacagaagcaacacaacttgcaacattaagaaaactatgcatagaaggaaaaataactaatattacaaccgatagtagatgtccaacacaaggtgaagcgaccttacccgaagaacaagatcaaaactatgtgtgtaaacatacttatgtggatcgaggatggggaaatggatgtggcttattcggaaaaggatcattagtaacatgtgcaaaattccaatgtttagaaccaatagaaggaaaagtagtacaatatgaaaatctaaaatatacggtaataataacagtacatactggtgaccaacatcaagtaggaaatgaaacacaaggagtcacagctgaaatcacaccacaagcatcaacaacagaagcgatattaccagaatatggtacattaggactagaatgctcaccacgaacaggattagattttaatgaaatgatattactaacaatgaaaaacaaagcatggatggtacatcgacaatggttctttgacctaccattaccttggacatccggagcaacaacggaaacaccaacatggaatagaaaagaattactggtaacattcaaaaatgcacatgcaaaaaaacaagaagtagtagtactaggatcacaagaaggggcaatgcatacagcactcacaggagcaacagaaatacaaaacagtggtggaacatcaatttttgcaggtcacttaaaatgtagactaaaaatggataaattagaattaaagggtatgagttatgctatgtgtacaaacacatttgtactaaaaaaagaagtcagtgagacacaacacggaacaatattaataaaagtagaatataaaggcgaggacgtcccttgcaaaataccattctcgaccgaagatggacaaggaaaggcacacaacggaagacttataacagcaaacccagtagttacaaaaaaagaagaaccagttaatatagaagcggaaccaccatttggagaatcaaatatcgtaattggaataggagacaacgctcttaaaataaattggtacaaaaaaggatcatccataggaaaaatgtttgaagctacagcaagaggtgccagaagaatggcaatactaggtgatactgcttgggattttggaagctga

SEQ ID NO: 2328 - RNA, 75 nt, synthetic construct
  misc_feature 1..75: note = derived and/or modified CDS sequence (opt11) from Homo sapiens__SigSeq(TPA)/SStPA
  source 1..75: mol_type = other RNA
atggacgcgatgaagcgcgggctctgttgcgtgctcttgctctgtggcgcggtctttgtcgatagcgtgaccggg

SEQ ID NO: 2329 - RNA, 489 nt, synthetic construct
  misc_feature 1..489: note = derived and/or modified CDS sequence (opt11) from Helicobacter pylori J99__Ferritin
  source 1..489: mol_type = other RNA
gacatcatcaaactcctcaacgaacaagtcaacaaagaaatgcaatcctccaacctatacatgagcatgtcctcatggtgctacacccactccctcgacggcgccggcctcttcctcttcgaccacgccgccgaagaatacgaacacgccaaaaaactcatcatcttcctcaacgaaaacaacgtcccagtccaactcacctccatctccgcccccgaacacaaattcgaaggcctcacccaaatcttccaaaaagcctacgaacacgaacaacacatatccgaatccatcaacaacatcgtcgaccacgccataaaatccaaagaccacgccaccttcaacttcctccaatggtacgtcgccgaacaacacgaagaagaagtcctattcaaagacatcctcgacaaaatcgaactcatcggcaacgaaaaccacggcctctacctcgccgaccaatacgtcaaaggcatcgccaaatcccgcaaatcc

SEQ ID NO: 2330 - RNA, 450 nt, synthetic construct
  misc_feature 1..450: note = derived and/or modified CDS sequence (opt11) from Woodchuck hepatitis virus__WHbcAg
  source 1..450: mol_type = other RNA
atggacatcgacccctacaaagaattcggctcctcctaccaactcctcaacttcctccccctcgacttcttccccgacctcaacgccctagtcgacaccgccaccgccctctacgaagaagaactcaccggccgcgaacactgctccccccaccacaccgccatccgccaagccctcgtctgctgggacgaactcaccaaactcatcgcctggatgtcctccaacatcacctccgaacaagtccgcaccatcatcgtcaaccacgtcaacgacacctggggcctcaaagtccgccaatccctctggttccacctctcctgcctcaccttcggccaacacaccgtccaagaattcctcgtctccttcggcgtctggatacgcacacccgccccctaccgcccccccaacgcccccatcctctccaccctcccagaacacaccgtcatctgc

SEQ ID NO: 2331 - RNA, 303 nt, synthetic construct
  misc_feature 1..303: note = derived and/or modified CDS sequence (opt11) from Japanese encephalitis virus__Cterm-JEV/JEV
  source 1..303: mol_type = other RNA
gggagcacgctcgggaaagcgttctcgaccacgctcaagggcgcgcaaaggctagcggccttgggcgataccgcgtgggatttcgggagcataggcggggtctttaactcgatcgggcgcgcggtccatcaagtgttcgggggcgcgttcaggaccttgttcgggggcatgagctggatcacgcaagggctcatgggcgcgctcttgctctggatgggggtcaatgccagggacaggagcatagccttggcctttctagcgaccgggggcgtgctcgtgttcttggccacgaacgtgcacgcg

SEQ ID NO: 2332 - RNA, 15 nt, synthetic construct
  misc_feature 1..15: note = derived and/or modified CDS sequence (opt11) from Artificial__MKRKK
  source 1..15: mol_type = other RNA
atgaagaggaagaag

SEQ ID NO: 2333 - skipped

SEQ ID NO: 2334 - RNA, 27 nt, synthetic construct
  misc_feature 1..27: note = derived and/or modified CDS sequence (opt11) from Artificial__Linker(G4SG4)
  source 1..27: mol_type = other RNA
ggggggggggggagtgggggggggggg

SEQ ID NO: 2335 - RNA, 51 nt, synthetic construct
  misc_feature 1..51: note = derived and/or modified CDS sequence (opt11) from Foot-and-mouth disease virus__F2A/P2A
  source 1..51: mol_type = other RNA
aacttcgacctcctcaaactcgccggcgacgtcgaatccaaccccggcccc

SEQ ID NO: 2336 - RNA, 300 nt, synthetic construct
  misc_feature 1..300: note = derived and/or modified CDS sequence (opt11) from DENV-1 CYD23__C
  source 1..300: mol_type = other RNA
atgaacaatcaaaggaaaaagaccgcgcgcccgagctttaacatgctcaagcgcgcgcgcaatcgcgtgagcacggtctcgcaattggccaagcgctttagcaagggcctgctctcgggccagggcccgatgaagctcgtgatggcgttcatagcctttctcaggttcttggccatacccccgaccgcgggcatactcgcgcgctggggctcgttcaagaaaaatggcgcgatcaaggtcttgcgcgggttcaagaaagagatctcgaacatgctcaatatcatgaacaggcgcaggaaa

SEQ ID NO: 2337 - RNA, 342 nt, synthetic construct
  misc_feature 1..342: note = derived and/or modified CDS sequence (opt11) from DENV-1 CYD23__C-SSc
  source 1..342: mol_type = other RNA
atgaacaatcaaaggaaaaagaccgcgcgcccgagctttaacatgctcaagcgcgcgcgcaatcgcgtgagcacggtctcgcaactggccaagcgctttagcaagggcctgctctcgggccagggcccgatgaagctcgtgatggcgttcatagcctttctcaggttcttggccatacccccgaccgcgggcatactcgcgcgctggggctcgttcaagaaaaatggcgcgatcaaggtcttgcgcgggttcaagaaagagatctcgaacatgctcaatatcatgaacaggcgcagaaaatcggtcacgatgttgctcatgctcatgcccacggccttggcc

SEQ ID NO: 2338 - RNA, 273 nt, synthetic construct
  misc_feature 1..273: note = derived and/or modified CDS sequence (opt11) from DENV-1 CYD23__pr
  source 1..273: mol_type = other RNA
ttccacctcaccacccgcggcggcgaaccccacatgatcgtctccaaacaagaacgcggcaaatccctcctcttcaaaacctccgccggcgtcaacatgtgcaccctcatcgccatggacctcggcgaactctgcgaagacaccatgacctacaaatgcccccgcatcaccgaagccgaacccgacgacgtcgactgctggtgcaacgccaccgacacctgggtcacctacggcacctgctcccaaaccggcgaacaccgccgcgacaaacgc

SEQ ID NO: 2339 - RNA, 225 nt, synthetic construct
  misc_feature 1..225: note = derived and/or modified CDS sequence (opt11) from DENV-1 CYD23__M
  source 1..225: mol_type = other RNA
tccgtcgccctcgccccccacgtcggcctcggcctagaaacccgcaccgaaacctggatgtcctccgaaggcgcctggaaacaaatccaacgcgtcgaaacctgggccctccgccaccccggcttcaccgtcatcgccctcttcctcgcccacgccatcggcacctccatcacccaaaaaggcatcatcttcatcctcctcatgctcgtcaccccctccatggcc

SEQ ID NO: 2340 - RNA, 498 nt, synthetic construct
  misc_feature 1..498: note = derived and/or modified CDS sequence (opt11) from DENV-1 CYD23__prM
  source 1..498: mol_type = other RNA
ttccacctcaccacccgaggcggcgaaccccacatgatcgtctccaaacaagaacgcggcaaaagcctactcttcaaaacctccgccggcgtcaacatgtgcaccctcatcgccatggacctaggcgaactatgcgaagacaccatgacctacaaatgcccccgcatcaccgaagccgaacccgacgacgtcgactgctggtgcaacgcaaccgacacctgggtcacctacggcacatgctcccaaaccggcgaacaccgccgagacaaacgatccgtcgccctcgcaccccacgtcggcctcggcctagaaacccgaaccgaaacctggatgtcctccgaaggcgcctggaaacaaatccaacgcgtcgaaacctgggccctccgccaccccggcttcaccgtaatcgccctcttcctcgcccacgccatcggcacctcaatcacccaaaaaggcatcatcttcatcctactcatgctcgtcaccccctccatggcc

SEQ ID NO: 2341 - RNA, 1485 nt, synthetic construct
  misc_feature 1..1485: note = derived and/or modified CDS sequence (opt11) from DENV-1 CYD23__E
  source 1..1485: mol_type = other RNA
atgcgatgcgtcggcataggaagcagggacttcgtagaaggcctaagcggagcaacgtgggtcgacgtagtcctagaacacggcagctgcgtaacaacaatggcaaaagacaaaccaaccctagacatagaactcctgaaaacagaagtcaccaacccagccgtactacgaaaactatgcatagaagcaaaaataagcaacacgaccaccgacagccgatgccccacccaaggagaagccaccctagtagaggaacaagacgccaacttcgtatgcagaagaacattcgtagaccgaggatggggaaacggctgcgggctattcggaaaaggaagcctcataacctgcgctaaattcaaatgcgtaaccaaactagaggggaaaatagtccaatacgaaaacctcaaatacagcgtaatcgtaacagttcacacaggagaccaacaccaagtaggcaacgaaagcacagaacacggaacaacagcaacgataacgccccaagcccccacaacagaaatacaactaacagactacggagccctgacactcgactgcagccccagaacaggcctagacttcaacgaaatggtactgctgacaatgaaagagaaaagctggctagtacacaaacagtggttcctagacctgccactcccctggacaagcggagcaagcacctcacaggaaacctggaaccggcaggacctcctagtgacattcaaaacagcacacgccaagaaacaagaagtcgtcgtcctaggcagccaagaaggggcaatgcacaccgcactaacaggcgcgacagaaatacaaacctccgggacgacaacgatattcgcaggccacctcaaatgccgcctcaaaatggacaaactcaccttaaaaggcatgagctacgtcatgtgcacaggatcattcaaactggaaaaagaagtagcagaaacccaacacggcacagtcctagtccaaatcaaatacgaaggaacagacgccccatgcaaaatacccttcagtacacaagacgaaaaaggcgtaacacaaaacggcagactcatcaccgcaaatccgatagtcaccgacaaagaaaagcccgtaaacatagaagcagagccaccgttcggcgaaagctacatcgtaataggggccggcgaaaaagccctaaaactcagctggttcaagaaaggaagctccatcggcaaaatgttcgaagccacggccagaggcgcacgccgaatggccatccttggggacaccgcatgggacttcggatccatcggcggagtgttcaccagtgtcggaaagctagtacaccaaatcttcggaacagcgtacggcgtgctattcagtggggtaagctggacgatgaaaatcggtataggtgtcctactcacgtggctaggactcaactccaggagtaccagcctgagcatgacctgcatcgcagtaggactcgtcacgctgtacctaggagtgatggtccaagcc

SEQ ID NO: 2342 - RNA, 1983 nt, synthetic construct
  misc_feature 1..1983: note = derived and/or modified CDS sequence (opt11) from DENV-1 CYD23__prME
  source 1..1983: mol_type = other RNA
ttccacctcaccacccgcggcggggaaccccacatgatcgtctcaaaacaggaacgaggcaaaagcctactcttcaaaacatccgcaggcgtcaacatgtgcacactaatcgcaatggacctgggagaactatgcgaagacaccatgacctacaagtgccctagaataacggaagcagaaccagacgacgtcgactgctggtgcaacgcaaccgacacctgggtcacctacggaacctgctcacagacaggcgaacacagacgagacaaacgaagcgtggcgctagccccacacgtcggcctgggattagaaactagaacggaaacatggatgtcctcggaaggcgcctggaaacaaatacagagagtcgagacctgggcactcagacaccccggattcacagtaatagcactcttcctggcccacgccatagggaccagcatcacacaaaaaggaatcatcttcatcctcttaatgctcgtaactccgtcaatggcgatgcgctgcgtcggaataggatccagagactttgtcgaaggactatctggcgcaacatgggtagacgtcgtcctagaacacggctcttgcgtcaccacaatggccaaagacaaacccacactcgacatagaactcctcaaaacagaagtaacaaacccagccgtactccgcaaactctgcatagaagccaaaatcagcaacaccacaaccgactcccgttgccccacacaaggggaagccacactcgtcgaagaacaagacgccaacttcgtctgccgccgcaccttcgtcgacaggggctggggaaacggctgcggccttttcggaaaaggatcactaataacctgcgcgaaattcaaatgcgtcaccaaactagagggaaagatcgtccaatacgagaacctaaaatacagcgttattgtaacagtacacacaggagaccaacaccaagtaggaaacgaatccaccgagcacggcactacggcaaccatcacccctcaagcccccaccacagaaatacaactaaccgactacggcgccctgacactagactgctcacccagaacaggactcgacttcaacgaaatggtcctactaaccatgaaggaaaaatcctggctggtacacaaacagtggttcttggacctaccgcttccctggaccagcggcgcctccacaagccaagagacatggaaccgccaagacctcctagtaacattcaaaacggcccacgcaaagaaacaagaagtggtggttctcggctcgcaggaaggagcaatgcacacggccctaacgggagcgaccgaaatacagacctccggtaccaccacaatcttcgccggacacctaaaatgccgactcaaaatggacaaattaaccctgaaagggatgtcctacgtcatgtgcaccggctccttcaaattagaaaaagaagtagcagaaacgcaacacggcaccgtcctagtccaaatcaaatacgaaggaaccgacgcaccatgcaaaatcccgttctcaacccaagacgaaaaaggagtaacacaaaacggacgcctcatcacggccaaccccatcgtgacagacaaagaaaaacccgtaaacatcgaagcggaacctcccttcggcgaatcatacatagtaataggagcaggagaaaaggccctcaaactaagctggttcaaaaagggaagctcaataggcaaaatgttcgaagcaacagccaggggcgcccgcagaatggcaatcctcggcgacaccgcatgggacttcggatccataggtggggtcttcaccagcgttgggaagttagtacaccaaatattcggcacagcctacggagtcctatttagcggcgtatcatggacgatgaaaatcggaataggagtgctcctgacctggctgggactgaacagcaggagcacgagcctatcaatgacatgcatagcggtaggcctcgtaacgctatacctcggcgtcatggtacaagca

SEQ ID NO: 2343 - RNA, 2025 nt, synthetic construct
  misc_feature 1..2025: note = derived and/or modified CDS sequence (opt11) from DENV-1 CYD23__SSc-prME
  source 1..2025: mol_type = other RNA
tctgtcaccatgctactcatgctcatgccgaccgccctagcctttcacctcaccacacgcggaggggaaccacacatgatcgtctcaaaacaagaacggggaaaatccctcctcttcaaaacatccgccggcgtaaacatgtgcactctcatcgccatggacctgggtgaactctgcgaagacaccatgacctacaaatgcccccgcataacagaagcagaacccgacgacgtcgactgctggtgcaacgccaccgacacctgggtcacgtacggaacatgctcacaaaccggcgaacaccgtcgcgacaaacgaagcgtcgccctcgccccacacgtcggcctagggctagaaacacggaccgaaacctggatgagctccgaaggagcctggaaacaaatccagcgcgtggaaacatgggccctaagacaccccggattcacagtaatcgccctcttcctcgcacacgccattggcacttctatcacacaaaaaggcatcatcttcatactccttatgctcgtaaccccctccatggccatgcgctgtgtcggaatcggcagccgcgactttgtcgaaggcctcagtggagccacatgggtcgacgtagtcctcgaacacggaagctgcgtaaccaccatggcaaaagacaaacccaccctggacatcgaactactaaaaaccgaagtaaccaaccccgccgtactaaggaaactctgcattgaagccaaaatcagcaatacaacgacagactcccggtgccccactcagggcgaagctacgctagtggaagaacaagacgcgaacttcgtatgcagacgcacattcgttgacagaggatggggcaacggctgcggcctgttcggcaaaggcagcctcataacctgcgctaaatttaaatgcgtaacaaaactggaaggcaagatcgtccaatacgaaaacctcaaatatagtgtaatagtaaccgttcacaccggagaccagcatcaagtcggcaacgagtccaccgagcacggaaccaccgccaccatcacgccccaggcccccaccaccgaaatacaactcacggactatggagccctcaccctagactgcagcccccgcaccggcctcgacttcaacgaaatggtactactaaccatgaaagagaaaagctggctcgtccacaaacaatggttcctggacctaccactaccatggaccagcggcgccagcacatcccaagaaacatggaacagacaggacctactcgtcacgttcaaaaccgcccacgccaagaaacaagaagtcgtcgtactaggctcgcaagaaggcgccatgcacacagcactcaccggcgccaccgaaatccaaacctcaggcaccaccacaatattcgcaggccacctgaaatgtcgcctcaaaatggacaaactcacactcaagggcatgagctacgtcatgtgcacaggcagcttcaaactcgagaaagaagtagccgaaacacaacacggaacagtccttgtccaaataaagtacgaaggaacggacgccccatgcaaaatcccattctcaacccaggacgaaaaaggcgtgactcaaaacggacgcctaataacggccaacccgatagtcacagacaaagaaaaacccgtgaacatcgaagcggaaccaccgttcggcgagagttacatagtgatcggagcaggagaaaaggccctaaaactcagctggttcaagaaaggctcctccatcggaaaaatgttcgaagccacggcacgcggtgcccgaagaatggccatactaggcgacaccgcgtgggacttcggttccatcggaggcgtcttcaccagtgtaggcaagctagtccaccaaatattcggcaccgcatatggagtactattctcaggagtaagctggacaatgaaaatcggcataggagtgctactaacgtggctaggactaaactcaagaagcaccagcttaagcatgacatgcatcgcagtaggcctcgtcacactctacctaggtgtaatggtacaagca

SEQ ID NO: 2344 - RNA, 2325 nt, synthetic construct
  misc_feature 1..2325: note = derived and/or modified CDS sequence (opt11) from DENV-1 CYD23__C-prME
  source 1..2325: mol_type = other RNA
atgaacaaccaacggaagaaaaccgcccgcccgagcttcaacatgctcaaacgagcaagaaaccgagtaagcaccgtatcccaactcgccaaacgattcagcaaaggcctactgtccggccaaggcccaatgaaactcgtcatggcattcatcgccttcctacgattcctcgcaatccctcccactgcaggcatcctcgcacgatggggctcattcaagaaaaatggagccattaaagtcctacgcggattcaaaaaggaaatctcgaacatgttaaacataatgaacaggcgccgcaagagcgtcaccatgctccttatgctcatgccaacggccttagcctttcaccttaccacccgcggaggagagccccacatgatagtctcaaaacaagagcgaggtaaaagcctactcttcaaaacgtccgccggcgtaaacatgtgcacactaatagccatggatctcggtgagctttgcgaagacaccatgacatacaaatgcccccgcataacagaagccgaacccgacgacgtcgactgctggtgcaacgccaccgatacatgggtcacttacggaacctgctcccaaaccggcgaacacagacgagacaaaaggtcagtagccctagccccacacgtgggcctaggactcgaaacacgcacggaaacgtggatgtcctccgaaggggcctggaaacaaatccaacgagtggaaacctgggcactgagacaccccggcttcacagtaatcgcactctttctagcacatgcaataggcacctcaatcacacaaaaaggcataatcttcatccttctcatgcttgtcacaccctccatggccatgcgatgtgtagggataggatcccgagacttcgtagaaggactcagcggagcaacctgggtcgacgtagtgctcgaacacggctcctgcgtcacgacgatggcaaaagacaaaccaaccctcgacatagaactgcttaaaacggaggtcaccaaccccgccgtactcaggaagctctgcatcgaagccaaaataagcaacacgaccaccgacagccgatgcccaacccagggagaagcgaccctagtagaagaacaagatgccaacttcgtctgccgacgcaccttcgtcgaccgaggatggggcaacggatgcggactattcggaaaaggcagcctgataacctgcgccaaattcaaatgcgtgacaaaactagaagggaaaatcgtccaatacgagaacctaaaatattccgtaatcgtaacagtccacacaggcgaccaacaccaggtcggaaacgaaagcaccgaacacggcaccacggccaccatcaccccacaagcccctacaaccgaaatacagctaacagactacggagccctcacattggactgcagtccccgtaccggcctggactttaacgaaatggtactcctcaccatgaaggagaaatcctggctagtacataaacaatggttcctcgacctccccctaccctggacatccggggcatcgacatcacaagagacatggaaccgccaagatctcctcgtcaccttcaagaccgcacacgcaaagaaacaagaagttgtagtccttggaagccaagaaggcgcaatgcacacagcactcaccggagccaccgagatccaaacctcaggaacaacgaccatatttgcgggacacctcaaatgccgactcaaaatggacaaactaacactaaaaggcatgtcatacgtaatgtgcacaggctccttcaaactcgagaaggaggtggcagaaacccagcacgggaccgtcctcgtacagataaaatacgaaggcaccgatgccccctgcaagatcccctttagcacacaagacgaaaaaggagtaactcaaaacggacgcctaataacagccaaccccatcgtcaccgacaaagagaaacccgtgaacatagaagcagagccaccgttcggcgaatcatacatagtgataggagccggagaaaaagccctaaaactcagctggttcaagaaaggatcatcaatcggcaaaatgttcgaggcaacagcgcgcggagcccggagaatggcaatcttaggcgacactgcctgggacttcggcagcatcggcggagtcttcacctcggtcggcaaacttgtacaccaaattttcgggaccgcttacggagtcctattctcaggcgtaagctggacaatgaaaatcggtatcggcgtactcctaacatggctcgggctaaacagtcgcagcactagcttaagcatgacatgcatcgccgttggcctcgtgacactgtacttaggtgtaatggtacaggca

SEQ ID NO: 2345 - RNA, 45 nt, synthetic construct; identical to SEQ ID NO: 1585
  misc_feature 1..45: note = derived and/or modified CDS sequence (opt11) from DENV-1 CYD23__SSc
  source 1..45: mol_type = other RNA

SEQ ID NO: 2346 - RNA, 57 nt, synthetic construct
  misc_feature 1..57: note = derived and/or modified CDS sequence (opt11) from DENV-1 CYD23__SSopt
  source 1..57: mol_type = other RNA
atgaaacgcaagaaatcggtcacgatgctgctcatgctcatgcccacggccctggcc

SEQ ID NO: 2347 - RNA, 57 nt, synthetic construct
  misc_feature 1..57: note = derived and/or modified CDS sequence (opt11) from DENV-1 CYD23__SSm
  source 1..57: mol_type = other RNA
atgacccaaaaaggcatcatcttcatcctcctcatgctcgtcaccccctccatggcc

SEQ ID NO: 2348 - RNA, 1488 nt, synthetic construct
  misc_feature 1..1488: note = derived and/or modified CDS sequence (opt11) from DENV-1 CYD23__E
  source 1..1488: mol_type = other RNA
atgcgctgcgtaggaatagggagcagggacttcgtcgaaggcctgagtggggcaacctgggtggacgtcgtcctagaacacggaagctgcgtgaccaccatggcaaaagacaaacccacactcgacatagaactactcaaaaccgaagtaacaaatccagccgtcctacgaaaactgtgcatcgaagccaaaatctcaaacacaacaaccgacagccggtgccccacacaaggagaagccaccctagtagaagaacaagacgccaacttcgtatgtcgacgcacgttcgtcgaccgcggctggggcaacggctgcggcctcttcgggaaaggaagcctaataacatgcgcaaaatttaaatgcgtcacgaaactagaagggaaaatagtacaatacgaaaacctcaaatacagcgtaatagtaaccgtccacacaggggaccagcaccaggtaggaaacgaatcaaccgagcacggaaccacagccaccataactccccaagcacccacaacagaaatccaactcaccgactacggggctctcaccctcgactgctcaccgcgaacaggcctggacttcaacgaaatggtactcctaaccatgaaagagaaaagctggctggtccacaaacaatggttcctagacctaccgctaccatggacaagcggagcctccaccagccaagaaacctggaacagacaagacctcctagtcacattcaaaaccgcacacgcaaagaaacaagaagtcgtcgtcctagggagccaagaaggcgcaatgcacaccgcactgacgggagcaacagaaatccaaacatccggaacaaccacaatattcgccggacacctaaaatgccgcctaaaaatggacaaactaacactgaaaggcatgagctatgtaatgtgcacaggctcgttcaaactcgaaaaagaagtcgccgaaacacaacacgggacagtcctagtacaaatcaaatacgagggcaccgacgcgccctgcaaaataccattcagcacccaggacgagaaaggcgtcacacaaaacggacgcctaatcacagccaacccaatagtaacagacaaagagaaacccgtaaacatagaagcagaaccaccattcggcgaatcctacatcgtaataggcgcgggagaaaaagccctaaaactaagctggttcaagaaaggttccagcatcggcaaaatgttcgaagcgaccgccaggggagcacgacggatggccatcctaggagacaccgcctgggacttcggaagcataggcggagtcttcacatcagtcggaaagctagtccaccaaatcttcggaaccgcatacggagtcctcttctcgggagtgagctggaccatgaaaataggcataggagtactactaacatggcttggcctgaacagcagatccacatccctgagcatgacctgcatcgcagtcggactcgtcaccctctacctcggcgtcatggtccaagcataa

SEQ ID NO: 2349 - RNA, 1182 nt, synthetic construct
  misc_feature 1..1182: note = derived and/or modified CDS sequence (opt11) from DENV-1 CYD23__EdelTM-variant (aa1-394)
  source 1..1182: mol_type = other RNA
atgcgctgcgtcggcatcggctcacgcgacttcgtcgaaggactatccggcgccacctgggtcgacgtcgtactcgaacacggctcgtgcgtcaccacaatggccaaagacaaaccaacactcgacatagaactcctcaaaacagaagtcaccaacccggcagtcctacgcaaactctgcatcgaagccaaaatatccaacaccacaaccgactccagatgccccacccaaggcgaagccacactcgtagaggaacaagacgccaacttcgtctgccgccgcacattcgtagatcgcggctggggcaacggctgcggcctcttcggcaagggcagcctgatcacatgcgcaaaattcaagtgcgtcacaaaacttgaaggaaaaatagtccaatacgaaaacctcaaatactcagtaattgtgaccgtccacaccggcgaccaacaccaagtaggaaacgaaagcacagaacatggcacgacagccacgatcaccccacaagcccccacaacagaaatccaactcacagactacggcgcactaaccctcgactgctcgcccagaaccggcctagacttcaacgaaatggtcctactaaccatgaaagagaaaagctggctagtccacaaacaatggttcttagacctaccactcccctggacctccggcgccagcaccagccaagaaacctggaaccgccaagacctcctagtcacattcaaaaccgcacacgccaagaaacaagaagtcgtcgtcctcggatcccaagaaggcgccatgcacaccgccctgacaggcgccaccgaaatccaaaccagcggcaccaccacaatcttcgccggacacctcaaatgccgcctaaaaatggacaaactaaccctaaagggcatgtcgtacgtaatgtgcaccggctcattcaagctcgaaaaagaagtagccgaaacccagcacggaacggtcctagtccaaatcaagtacgaaggcacagacgccccctgcaaaatccccttctccacacaggacgaaaaaggagtaacccaaaacggccgcctcattacagccaaccccatcgtcaccgacaaagaaaaacccgtaaacatagaagcagaaccacccttcggcgaaagctacatcgtcataggcgccggcgaaaaagccctcaaactatcatggttcaagaaa

SEQ ID NO: 2350 - RNA, 1275 nt, synthetic construct
  misc_feature 1..1275: note = derived and/or modified CDS sequence (opt11) from DENV-1 CYD23__EdelTM-variant (aa1-424)
  source 1..1275: mol_type = other RNA
atgcgatgcgtcggaatcggcagtcgcgacttcgtagaaggactcagcggagcgacctgggtcgacgtagtcctagaacacgggagctgcgtaaccaccatggccaaagacaaacccaccctcgacatagagctcctcaaaacagaagtcacgaacccagccgtactccgaaaactatgcatcgaagccaagatcagcaacacaaccaccgactcacgctgcccaacccaaggcgaagccaccctagtagaagaacaagacgcaaacttcgtctgccgacgcaccttcgtagaccgcggctggggcaacggctgcgggctattcggcaaaggctcactaatcacatgcgccaaattcaaatgcgtaaccaaactcgaaggcaaaatcgtccaatacgaaaacctcaaatactccgtaatcgtaaccgtccacaccggcgaccagcaccaagtaggaaacgaaagcaccgaacacggcaccaccgcaaccatcacaccccaagcccccacgaccgaaatccaactgaccgactacggagccctaacgctcgactgcagcccccgcacaggcctcgacttcaacgaaatggtcctcctaacgatgaaagaaaagagctggttagtccacaaacaatggttcctcgacctccccctaccctggacaagcggcgcctccaccagccaagaaacatggaaccgccaagacctacttgttaccttcaaaaccgcccacgctaagaaacaagaagtggtcgtactaggcagccaagaaggcgcaatgcacaccgccctgacaggggccacagaaatccaaacatccggaaccaccaccattttcgccggccacctaaaatgccgcctgaaaatggacaaactcaccctgaaaggaatgtcatacgtaatgtgcaccggatccttcaaactagaaaaagaagtagcagaaacacaacacggaaccgtcctagtccaaataaaatacgaaggcacagacgccccctgcaaaatccccttctccacacaagacgaaaaaggcgtaacccaaaacggcagactcataacggccaaccccatagtaaccgacaaagaaaaacccgtcaacatagaggccgaaccacccttcggcgaatcatatatagtcatcggcgcaggagaaaaagccctaaaactatcctggttcaagaaaggatcctcaatcggcaaaatgttcgaagcaaccgcacgaggagccagacgcatggccatcctcggcgacacagcctgggacttcggctcataa

SEQ ID NO: 2351 - RNA, 1266 nt, synthetic construct
  misc_feature 1..1266: note = derived and/or modified CDS sequence (opt11) from DENV-1 CYD23__EdelTM-variant (aa1-421)
  source 1..1266: mol_type = other RNA
atgagatgcgtaggcatcggatcccgcgacttcgtcgaaggcctctccggagccacatgggtcgatgtagtactagaacacggatcctgcgtaacaaccatggccaaagacaaacccacccttgacatcgaactcctcaaaacagaagtcaccaaccccgccgtactccgcaaactatgcatcgaagccaagatctccaacacaaccacagactcccgatgcccaacacaaggcgaagccaccctagtcgaggaacaggacgccaacttcgtctgccgcagaaccttcgtagacagaggatggggcaacggatgcggcctattcggaaaaggctcactcataacctgtgccaaattcaaatgcgtcaccaagctcgagggcaaaatcgttcaatacgaaaacttaaaatactcagtcatcgtcaccgtacacaccggcgaccaacaccaagtcggcaacgaatccaccgaacacggcaccacagccaccatcacaccacaagccccaacaaccgaaatccagctcacggactacggagcactaacactcgactgcagcccccgcaccggacttgatttcaacgaaatggtactcctaaccatgaaagaaaaatcctggctagtccacaagcaatggttcctcgacctcccactcccctggacctccggcgccagcaccagccaagaaacatggaacagacaagacctcctcgtcacattcaaaacagcacacgccaagaaacaagaagtcgtagtcctcggctcccaagagggcgccatgcacaccgcactcacaggcgccaccgaaatacaaaccagcggcacaacaaccatcttcgcagggcacctaaaatgccgcctaaaaatggacaaactcaccctcaaaggcatgtcctacgtcatgtgcaccggcagcttcaagctcgaaaaagaagtcgccgaaacccaacacggaacagtcctagtccaaatcaaatacgaaggaacagacgcaccctgcaaaatacccttctccacacaagacgaaaaaggcgtcacccaaaacggccgcctaataacagcaaaccccatagtaaccgacaaagaaaaacccgtcaacatcgaggcagaaccaccattcggagaatcatacatcgtaatcggcgccggcgaaaaagcactcaaactcagctggttcaagaaaggctcctccataggaaaaatgttcgaagccaccgcccgcggcgcccgacgcatggccatcctaggagacacagcatgggactaa

SEQ ID NO: 2352 - RNA, 2031 nt, synthetic construct
  misc_feature 1..2031: note = derived and/or modified CDS sequence (opt11) from DENV-1 CYD23__SSc-prME
  source 1..2031: mol_type = other RNA
atgagcgtcacgatgctactcatgctcatgcctaccgcactagccttccacctcaccacaagaggtggagaaccacacatgatcgtcagcaaacaagagaggggaaaatccctccttttcaaaacaagtgccggagtcaacatgtgcaccctcattgccatggacctgggcgagctgtgcgaagataccatgacctacaaatgcccccgcataaccgaagcagagccagacgacgtcgactgctggtgcaacgcaaccgacacatgggtaacctacggcacatgcagccaaaccggcgaacacagacgcgacaaaagaagcgtcgccctcgcaccacacgtcggccttggactcgaaacgcgaacggaaacctggatgtccagcgaaggcgcatggaagcaaatacaacgcgtggaaacgtgggcactacgccacccaggattcaccgtcatcgcactcttcctggcgcacgcaatcggaacttcaataacacagaaaggaatcatcttcatactactcatgttagtcaccccgagcatggccatgcggtgcgtaggaatagggagccgcgacttcgttgaaggactctcaggagccacatgggtcgacgtagtcctggaacacggatcatgcgtgacgacaatggccaaagacaaaccaaccctagacatagaactcctaaaaacagaagtcacaaaccccgcagtcctccgcaaactgtgcatagaagcaaaaataagcaacaccaccacagactccaggtgccccacccaaggagaagccaccctagtggaagaacaagacgccaactttgtgtgccgacgaacattcgtagaccgcggctggggaaacggatgcggactcttcggaaaaggaagcctaatcacatgcgcaaagttcaagtgcgtaacaaaactggaaggaaaaatagtccaatacgaaaacctaaaatacagcgtaatagtaacagtccacaccggagaccaacaccaagtcggaaacgagtccacagaacacgggacaaccgcaacaatcacgccacaggcacccaccacagaaatccaactcacagactacggagccctcaccctagactgctcaccacgaacaggactagacttcaacgagatggtactcctaaccatgaaagaaaagtcatggctagtccacaaacagtggttcctcgacctacccctcccatggacatccggagccagcacatcacaagaaacatggaacagacaagacctcctagtcacattcaaaacagcacacgcaaagaaacaagaagtcgtggtacttggaagccaagaaggcgccatgcacacagcactaaccggagcgaccgaaatacagacaagcggcaccaccacaatcttcgcaggccacctaaaatgccggctaaaaatggacaagctaacactcaagggaatgagttacgtcatgtgcaccggctcctttaaactagaaaaagaagtagcagaaacacaacacggcaccgtcctagtacaaataaagtacgagggaacggacgccccctgcaaaatcccattcagcacacaggacgaaaaaggggtcactcaaaacggacgactaatcaccgcaaaccccatcgtcaccgacaaagaaaagccggtaaacatagaagccgaaccgccgttcggcgaaagctacatagtaatcggggccggagaaaaagccctgaaactaagctggttcaagaaaggctcatccatcggaaaaatgttcgaagcaaccgcccgcggcgcccgcaggatggccatactcggcgacacagcgtgggacttcgggtccatcggcggcgtattcacctcagtagggaagctagtgcaccaaatcttcgggacagcatacggcgtcctcttctctggcgtaagctggaccatgaaaatcggcatcggcgtgctactgacctggctcggactaaactcgcgaagcacctccctgagcatgacctgcatcgcagtcggactcgtcaccctatacctaggcgtgatggtacaagcatag

SEQ ID NO: 2353 - RNA, 2031 nt, synthetic construct
  misc_feature 1..2031: note = derived and/or modified CDS sequence (opt11) from DENV-1 CYD23__SSc-prME(F108S)
  source 1..2031: mol_type = other RNA
atgtcagtaacaatgctcctcatgctaatgcccacggcactcgcattccacctaaccacacgcggaggcgaaccccatatgatcgtatccaaacaagaacgcggcaaaagcctactcttcaagacaagcgcaggcgtcaacatgtgcacattgatcgcaatggacctcggcgaactctgcgaagacaccatgacgtacaaatgcccacgcatcacagaagcggaaccagacgacgtagattgctggtgcaacgcaaccgacacgtgggtcacatacggaacctgctcacagacaggcgaacaccgccgagacaagagaagcgtggcactcgcgccccacgtaggcctcggcctagaaacaagaacagaaacatggatgtcttccgaaggcgcctggaaacaaatccagcgagtcgaaacatgggccctccgccacccgggatttacagtaatcgccctattcctagcgcacgccatagggacaagcataacccaaaaaggcataatattcatcttgctaatgctcgtaaccccctccatggccatgagatgcgtcggaatcggcagcagagacttcgtagaaggattgtcgggagcaacctgggtagacgtagtccttgaacacggcagctgcgtgacaacaatggcgaaagacaaaccaaccctagacatcgaactactcaaaacagaagtaacaaaccccgcagtgctacgcaaactctgcatcgaagcaaaaatcagcaacaccaccacagactccagatgtcccacccaaggtgaggccacgctcgtagaagaacaagacgccaatttcgtctgtagacgcacattcgtcgacagaggctggggcaacggctgcggcctaagcgggaagggctccctcataacctgcgcaaaattcaaatgcgtaaccaaactcgaaggaaaaatcgtacagtacgaaaacctcaagtactcagtcatcgtcaccgtacacacaggcgaccaacaccaagtcggaaacgaaagcaccgagcacggcaccacagccaccatcacaccacaagccccaactaccgaaatccaactgacagactacggagcactaacactcgactgcagcccacgaacaggacttgatttcaacgagatggtgctactcactatgaaagagaaaagctggctcgtgcacaaacaatggttcctagatctacccctcccgtggacaagcggggcctcaaccagccaggagacgtggaaccgccaagaccttctagtaacattcaagaccgcccacgccaagaaacaagaagtggtagtgctcggctcccaggaaggagccatgcacacagcactaacaggagcaaccgagatccaaacatcaggcaccaccaccatattcgccggacacctaaaatgccgattgaaaatggacaaactcacgctcaaaggaatgagctatgtcatgtgcacaggatccttcaaactcgagaaagaagtcgcagaaacgcaacacggaacagtcctcgtccaaataaaatacgaaggcaccgacgccccatgcaaaatacccttcagtacacaagacgaaaaaggagtaacacaaaacgggcgcctcataacagccaaccccatagtcaccgacaaagaaaaaccagtcaatatcgaggcggaacccccgttcggagaaagctacatagtcatcggcgcaggagaaaaagccctcaaactaagctggttcaagaaaggaagctcaatcggaaaaatgttcgaggcaacagcaagaggcgcacgccgcatggcaatcctaggcgacaccgcatgggacttcggcagcataggaggagtattcacctcggtcggcaaactcgtccaccaaatcttcggaaccgcctacggagtgctcttttcgggcgtaagctggaccatgaaaataggaataggcgttctactgacctggcttggactcaacagccgctcaacaagtctgagcatgacctgcatagcagtcggactcgtaacactgtacctcggcgtcatggtgcaagcctaa

SEQ ID NO: 2354 - RNA, 2031 nt, synthetic construct
  misc_feature 1..2031: note = derived and/or modified CDS sequence (opt11) from DENV-1 CYD23__SSc-prMEdelstem_TM-JEV
  source 1..2031: mol_type = other RNA
atgtccgtcaccatgctacttatgctcatgccaaccgccctagccttccacctgactacccggggcggcgaaccacacatgatcgtctccaaacaagaaaggggcaagtcactcctcttcaaaacaagcgccggcgtcaacatgtgcaccctcatagccatggacctgggagaactctgcgaagacaccatgacatataagtgccccagaatcacagaggccgaaccagacgacgtcgactgctggtgcaacgccaccgacacatgggtaacctacggcacatgcagccaaacaggagagcacaggcgtgataaaagaagcgtagccctagctccacacgtaggcctgggcctcgaaacaagaacagaaacctggatgtcttcagaaggggcctggaaacaaatccaacgagtagaaacatgggcgctccgacacccgggcttcaccgtcatcgccctcttcctagcccacgcaatcggaacctccataacccagaaaggcatcatattcatcctcctcatgctagtcacccccagcatggccatgcgatgcgtcggcatcggcagcagggacttcgtcgaaggcctctcaggagccacctgggtggacgtagtcctcgaacacggatcctgcgtcaccacaatggccaaagacaaaccaaccctagacatcgaactcctcaaaaccgaagtcacaaaccccgcagttctccgcaagctatgcatcgaagcgaaaatctcaaacacaacaaccgacagccggtgccccacccaaggagaagccaccctagtagaagaacaagacgccaatttcgtctgcaggcgcacattcgtcgaccggggatggggaaacggatgcggcttattcgggaaaggatccctaatcacatgcgccaaattcaaatgcgtcaccaaactcgaggggaaaatcgtacaatacgaaaacctcaaatactccgtaatcgtcaccgtccacacgggcgaccaacaccaagtcggcaatgaatcgacagaacacggcaccacagcaaccatcacaccacaggcaccgacaacagaaatacagctgaccgactacggagccctaaccctcgactgctcaccaagaaccggcttagacttcaacgaaatggtcctactaaccatgaaagagaaaagctggctagtacacaaacaatggttcctagacctcccactcccatggacctcaggagcctccacctcccaagaaacctggaaccgccaagacctcctcgtcacattcaaaacggcccatgccaagaaacaagaggtagtcgtcctaggttcgcaagagggagccatgcacacggccctcactggagccaccgagatccaaacctccggcacgaccaccattttcgccgggcatctaaaatgcagactgaaaatggacaaactaaccctcaaagggatgagctacgtcatgtgcacaggatctttcaaacttgagaaagaagtagcagaaacacaacacggcacggtccttgtccagatcaaatacgaaggaaccgacgcaccctgcaaaatccccttttctacccaagacgaaaaaggcgtcactcagaatggacgcctcataacagccaacccaatcgttaccgacaaagaaaagcccgtaaacatcgaagcagaaccgccattcggcgaatcctacatcgtaataggcgcaggagaaaaagccctaaaattaagctggttcaagaaaggcagcaccctaggaaaagcattttcaaccaccctcaaaggcgcacaaagactcgccgccctgggcgacaccgcatgggacttcggcagcataggaggcgtattcaactccatcggccgcgccgtgcaccaagtcttcggaggagcattcagaaccctcttcggaggcatgagctggatcacacaaggactaatgggtgccctactactctggatgggggtcaacgcccgagacagaagcatagccctcgcctttctcgcaaccggcggtgtcctagtattcctagccacgaacgtacacgcctaa

SEQ ID NO: 2355 - RNA, 2379 nt, synthetic construct
  misc_feature 1..2379: note = derived and/or modified CDS sequence (opt11) from DENV-1 CYD23__C-P2A-SSc-prME
  source 1..2379: mol_type = other RNA
atgaataaccagcgaaagaaaacagccagacccagcttcaacatgctaaaacgagccagaaacagagtcagcacggttagccaactagcaaaacggtttagcaaaggcctcctcagcggacagggccccatgaagctagtcatggcattcatagcattcctccgattcctagcaataccaccaacagccggcattctcgcacgatggggcagcttcaagaaaaacggagcaatcaaagtactcagaggattcaagaaagagatttccaacatgctgaacataatgaaccgacgacgcaaaaacttcgacctcctaaaactagcaggagacgtggaaagtaacccaggcccaagtgtcacaatgctactcatgctaatgccaacagcacttgccttccacctgaccacgcggggcggggaaccacacatgatagtaagcaaacaagaaagaggaaagagcctactctttaaaacaagcgccggcgtcaacatgtgcacgctcatcgcaatggacctcggggaactctgcgaagacacaatgacctacaaatgcccccgcataacggaagcggagccagacgacgtggactgctggtgcaacgcaaccgacacgtgggtaacatacggaacatgtagccaaacaggcgagcaccgccgggacaagagaagcgtcgcactggcccctcacgtcggcctcggactggagaccagaacagagacctggatgtcaagcgaaggagcatggaaacaaatacaacgtgtagaaacatgggcactaagacacccaggatttactgtcatagccctcttcctagcacacgcaataggaacttccataacacaaaaaggaataatattcatcctcctgatgctggtgactccatcaatggcgatgcgatgtgtaggcatcggcagcagggacttcgtagaaggattatccggagcaacctgggtcgatgtagttctcgaacacggaagctgcgtcacaaccatggccaaagacaaacctacgctcgacatcgaactcctcaaaaccgaagtaaccaacccggccgtcctaagaaaactctgcattgaagccaaaatcagcaacaccaccaccgacagccgatgtccaactcagggagaagcaacactcgtagaagaacaggacgccaatttcgtatgccgacgcacattcgtagacagaggctggggaaacggatgcggactattcgggaagggaagcctcctcacatgcgctaaattcaaatgcgttactaagctggaagggaaaatagtacaatacgaaaacctgaagtacagcgtaatcgtcacagtacacacgggagaccaacaccaggtgggaaacgaaagcaccgaacacggaacgacggccacaatcacaccgcaagccccaactaccgaaatacaactcacagactacggagcactgacacttgactgctccccgagaacgggcctagacttcaatgaaatggtcctactcacaatgaaagaaaaatcgtggctagtgcacaaacagtggttcctcgacctcccactcccgtggacaagcggcgcaagcacctcacaagaaacctggaaccgacaagacctcctcgtaacattcaaaacggcccacgccaagaaacaagaagtcgtcgtactaggcagccaagagggtgcaatgcacacagccctaaccggcgcaaccgaaatacaaaccagcggcaccacaaccatcttcgcgggacacctaaaatgcagactgaaaatggacaaactcacactgaagggcatgagctacgtaatgtgcaccggatcattcaaactagaaaaggaggtcgccgagacccaacacggcaccgtcctagtacagataaaatacgaagggacagacgcaccgtgcaaaatacccttctccacacaagacgaaaaaggagtaacccagaacggcaggctgatcacagccaaccccatagtcacagacaaagaaaaaccggtcaacatagaagccgaaccacccttcggagaaagctacatcgtaataggagccggagaaaaagcccttaaactgagctggttcaagaaaggctcatccataggaaaaatgttcgaagccacggcccgaggagcacgaaggatggcgatactgggcgacaccgcatgggactttggaagtatcggaggcgtgttcacctcagtcggaaagctagtccaccaaatcttcggaacagcatacggcgtcctcttctcgggcgtaagctggacgatgaaaataggtataggcgtgctcctaacgtggctcggactcaactcccggtccacaagcctgagcatgacatgcatcgcggtcggcctcgtaacactctacttgggcgtgatggtgcaagcatag

SEQ ID NO: 2356 - RNA, 2043 nt, synthetic construct
  misc_feature 1..2043: note = derived and/or modified CDS sequence (opt11) from DENV-1 CYD23__SSopt-prME(F108S)
  source 1..2043: mol_type = other RNA
atgaaacgtaagaaatcggtaaccatgttgctcatgctcatgcccacagccctcgcgttccatctcacaacaagaggaggagaaccccatatgatcgtctcgaaacaagaacgagggaaaagcctactgttcaaaacaagcgccggagtaaacatgtgcacactcatagcaatggacctaggagaactatgcgaggacacaatgacctacaaatgcccaaggataacagaagccgaaccagatgacgtcgactgttggtgcaacgccacagacacatgggtcacctacggcacatgcagccaaacaggagaacaccgccgggacaaacggtcggtcgccctcgctccccacgtcggcctcggactcgaaacgcgaaccgaaacctggatgagctcagagggcgcctggaaacaaatccaaagagtcgaaacctgggcgctcaggcacccaggcttcacggtcatcgccctgttcctggcgcacgctataggaacctcaatcactcagaaaggcataatcttcatcctcctcatgctcgtcaccccgagcatggccatgcgatgcgtaggaatcggaagccgagacttcgtagaaggactgagcggagccacctgggtcgacgtggtcctagaacacggaagctgcgtcaccacaatggcaaaagacaaaccaacactagacatagagctactcaaaaccgaggtcacaaacccagcagtactccgcaaactatgcatagaagccaaaatcagcaacaccacaaccgactcccgatgtccaacccaaggcgaagccacactcgtcgaggaacaagatgccaacttcgtctgcagacgcaccttcgtcgacagaggatggggaaacggctgcggcctatccggcaaaggatccctcataacatgcgcgaaattcaaatgcgtgaccaagctcgaaggaaaaatagtacaatacgaaaacctcaaatacagcgtgatcgtaacagtccacaccggagaccaacaccaagtcggcaacgaatccacagaacacgggaccaccgccactatcacacctcaagcaccaaccacagaaatacaactcaccgactacggcgccctcaccctagactgcagcccccgaaccggtctagacttcaacgaaatggtgcttctgactatgaaagagaaatcatggctggtccacaagcaatggttcctcgacctcccactaccgtggaccagcggagccagcaccagccaagaaacctggaacaggcaagacttgctcgtcaccttcaaaacagcacacgctaagaaacaagaagtggtagtccttggaagccaggaaggagcaatgcacacagcgctaacaggcgcgaccgagatacaaaccagtggcacaacaacaatcttcgccggccacctaaagtgccgcctaaaaatggacaaactcacacttaaaggaatgagctacgtgatgtgcacaggatcgtttaaactagaaaaagaggtcgctgaaacacaacatggcacggtcctagtccaaatcaaatacgaaggcaccgacgccccctgcaaaatacccttcagcacacaagacgaaaaaggcgttacccaaaacggacgactaataacagccaacccaatagtaacggacaaagagaaacccgtaaacatcgaggccgaaccacccttcggagaaagctatatcgtaatcggcgccggagaaaaagccttgaagctctcgtggttcaagaaaggatccagcatcggaaaaatgttcgaagccacagccagaggcgcccgcagaatggcaatcctaggcgacacggcatgggacttcggcagcatagggggcgtcttcacatcagtaggcaaattagtccaccaaatattcggaaccgcatacggggtactattcagcggagtatcctggacaatgaaaattggaatcggcgtactcctaacctggctaggcttaaatagccgcagcacatcactaagcatgacctgcatcgcagtaggcctcgtcacactatacctgggagtaatggtccaggcgtga

SEQ ID NO: 2357 - RNA, 2043 nt, synthetic construct
  misc_feature 1..2043: note = derived and/or modified CDS sequence (opt11) from DENV-1 CYD23__SSopt-prME(F96H)
  source 1..2043: mol_type = other RNA
atgaaacgtaagaaatcggtcacaatgctgctcatgctaatgcccacagcactcgcattccacctcaccacacgtggcggcgaaccacacatgatcgtaagcaaacaggaacgaggcaagagcctactgttcaaaacctcagcaggagtgaacatgtgcaccctaattgccatggacctcggcgaactttgcgaagataccatgacctacaaatgcccacgcatcacagaagctgaaccagacgatgtcgactgctggtgcaacgccaccgacacctgggtaacttacggaacctgctcacaaaccggcgagcacagaagagacaaaaggtccgtcgccctagcaccccacgtcggcctcggcctggaaacgcgtaccgaaacatggatgagctcagaaggcgcatggaaacaaatccaacgcgtcgaaacatgggccctcagacatccaggcttcacagtgatcgcactattcctcgcccatgcaatcggcacctccatcacacagaaaggtatcatcttcatcctactgatgctggtgacaccgagcatggctatgcgatgcgtcggaataggctcgagagacttcgtcgaaggactaagcggcgccacctgggtagacgtagtcctagaacacggcagttgcgttaccacaatggcaaaagacaaacccaccctagacatagaactactcaagacagaagtcaccaaccccgccgtactccgaaaactatgcatagaagcaaaaatcagcaacaccacaactgacagtaggtgccccacccagggggaggccacactcgtagaagaacaggacgcgaacttcgtatgccgccgcacccacgtagatcgaggatggggtaacggctgcggcctgttcggaaaaggcagcctcatcacatgcgccaaattcaaatgcgttacaaaactggaaggcaagatagtccaatacgaaaaccttaaatacagcgtaatcgtaaccgtccacacaggcgaccaacaccaagtaggaaacgaatccacagaacacggcaccacagcaaccatcactccccaagccccaaccaccgaaatacagctcaccgactacggcgctctaaccctcgactgcagcccacgaaccggcctcgacttcaacgagatggtactcttgaccatgaaagagaaatcatggctcgtacacaaacaatggttcctagatcttcccctaccatggacctccggagcctccacctcccaagaaacctggaacagacaagacctcctcgtcacctttaagaccgcccacgccaaaaagcaagaggtcgtggtcctcggctcccaagaaggcgccatgcatactgcactaaccggagccacagaaatccaaaccagcggcacaaccaccatattcgctggccacctaaaatgccgactcaaaatggacaaattaaccctcaaaggcatgagctacgtgatgtgcactggcagctttaaacttgaaaaagaagtcgcggaaacccaacacggcactgtcctcgtacaaataaaatacgaaggaaccgacgctccctgcaaaatccctttcagcacacaagacgaaaaaggagtcacccaaaacggacgcctcatcactgccaacccaatcgtaacagacaaagaaaaacccgtaaacatcgaagcagaaccacccttcggcgaatcctacatcgtaatcggagcaggcgaaaaggccctcaaactctcgtggttcaagaaaggctcctcgatcgggaaaatgttcgaagccaccgccagaggagccagaagaatggccatactaggcgataccgcctgggacttcggctccatcggaggagtcttcacctccgtcggcaaacttgtccaccagatcttcggcaccgcatacggcgtactcttctccggagttagctggaccatgaaaatcggaataggcgtcctcctcacctggctcggcctaaactccaggagcacaagcctttccatgacatgcatcgcggtaggactcgtcaccctctacctaggtgtcatggtacaagcgtaa

SEQ ID NO: 2358 - RNA, 2043 nt, synthetic construct
  misc_feature 1..2043: note = derived and/or modified CDS sequence (opt11) from DENV-1 CYD23__SSopt-prME(S186F)
  source 1..2043: mol_type = other RNA
atgaaacggaaaaagtcagtaaccatgctcctcatgctaatgcccaccgcactcgccttccatctcaccacacgcggaggcgaaccccacatgattgttagcaaacaagaaagaggaaaaagcctactattcaaaacctcagcaggcgtaaacatgtgcacactcatcgctatggacctaggcgaactctgcgaagacaccatgacctacaaatgcccacgcatcacagaagcagaacccgacgacgttgactgctggtgcaacgccacagacacctgggtcacctacggcacttgcagccaaaccggggaacaccgccgcgacaaacgatccgtagcactagcgccccatgtaggtctaggcctcgaaacacgaacagaaacgtggatgagctccgaaggagcctggaaacaaatacagcgcgtcgagacatgggcactgagacacccaggcttcaccgtgatcgccctcttcctcgcccacgccatcggcaccagtattacccaaaaaggaatcatcttcatacttctcatgcttgtaacaccatcaatggccatgcgctgcgtaggcatcggatcacgcgacttcgtagaaggcttaagcggcgcaacatgggtcgacgtagtcctagaacacgggtcctgcgtcacaacaatggcaaaagacaaaccgacactagacatcgaactactgaagaccgaagtcacaaaccccgccgtgctccgaaaactctgcattgaagcaaaaatcagcaacacaacaaccgacagccgatgcccaacgcagggcgaagccaccctagtcgaagaacaagatgccaacttcgtatgccgccgaacattcgtagaccgaggctggggcaacggctgcggactgttcgggaaggggagcctcataacctgcgccaaattcaaatgcgtcaccaaactggaagggaagatcgtacaatacgaaaacctaaaatacagcgtaattgtaaccgtccacacaggtgaccaacatcaagtgggcaacgaaagcaccgagcacggcacaaccgcgaccattacaccacaagccccaaccaccgagatccaactaacagattacggagcgcttacgctagactgcttcccccggacaggactggacttcaacgaaatggtcctgctaaccatgaaggaaaagtcctggcttgtccacaaacaatggttccttgacctcccactgccctggacatccggcgcaagcacttcacaagaaacctggaatagacaagacttactcgtaacattcaagaccgcacacgccaagaaacaagaagtcgtcgtactcggcagccaagaaggagcgatgcacaccgccctgaccggtgcaaccgaaatccaaacaagcggaactaccacgatcttcgccggacacctgaaatgccgcctaaaaatggacaaactgacactaaaaggcatgagctacgtcatgtgcacaggctccttcaagctcgaaaaagaagtagcagagacccagcacgggaccgtactcgtccagatcaaatatgaaggtacagacgccccctgcaaaataccgttctcaacgcaagatgaaaaaggagttacccagaacggacgactgataacagcaaatccaatcgtcacagacaaagagaaaccagtcaacatcgaggccgaacccccattcggagagtcctatatcgtaatcggagcaggagaaaaagccctcaaactatcctggttcaagaaaggtagctccatcgggaaaatgttcgaagccacagcccggggagcgcgacggatggcaatactcggcgacaccgcctgggacttcggctccataggcggcgtattcactagcgtgggcaagctcgtccaccagatcttcggaactgcctacggagtcctatttagcggagtaagctggacaatgaaaatcggcatcggcgtgctcctgacctggctgggcctgaactcccgatccacatccctgagcatgacctgcatcgcagtaggcctcgtaaccctgtatctcggcgtcatggtgcaggcctaa

SEQ ID NO: 2359 - RNA, 2043 nt, synthetic construct
  misc_feature 1..2043: note = derived and/or modified CDS sequence (opt11) from DENV-1 CYD23__SSopt-prME(R188L)
  source 1..2043: mol_type = other RNA
atgaaacgaaagaaaagcgtcacaatgctgctaatgctaatgcccacagcattagccttccatctcaccacacgagggggcgaaccccatatgattgtaagcaaacaggaacgcggaaaaagcctcctattcaaaacgagcgccggcgtaaacatgtgcaccctcattgccatggacctaggcgagctctgcgaagacacgatgacatacaaatgcccacgaatcaccgaagccgaaccagacgacgtcgactgttggtgcaacgccacagacacctgggtcacctacggcacatgctcacaaacgggcgaacaccggcgcgacaaacggtccgtggccctggccccacacgtcggtctaggactagaaacgagaacagagacctggatgagcagcgaaggggcctggaaacaaatccaacgcgtggaaacctgggcgctaagacaccccggcttcaccgtcatcgccctcttcctagcacacgccatcggaacctcaataacccaaaaaggcatcatattcatcctactcatgctggtcaccccaagcatggccatgcgctgcgtaggaatcggtagtagagacttcgtggaaggccttagcggcgcaacctgggtcgacgtcgtcctggaacacggttcatgcgtaaccacaatggccaaagacaaaccaaccctcgacatcgaactcctaaaaaccgaagtaacaaaccccgcagtcctcagaaaactgtgcatagaagcgaaaatttccaacaccacaaccgatagccgatgccccacccaaggcgaagccacactggtcgaagaacaggacgctaacttcgtatgccgacgcacattcgttgaccgcggctggggcaacggctgcggactattcggtaaaggcagccttataacatgcgccaaatttaaatgcgtaaccaaactcgagggcaaaatagtacagtacgaaaatctcaaatactccgtcatagtcacggtacacaccggcgaccaacatcaagtcggcaatgaaagcaccgagcacgggacaacggcaaccatcacaccgcaagcaccaacaacggaaatccaactcaccgactacggcgccctgacactcgactgcagccccttaacaggcctggacttcaacgaaatggttctcctaactatgaaagagaaaagttggctagtccacaaacaatggttcctagacctacctctaccctggacaagcggcgcctcaacctcccaggaaacatggaacagacaagacctacttgtgacattcaaaaccgcgcacgcaaagaaacaagaggtcgtagtactcggctcacaagaaggcgcgatgcacaccgccctgaccggtgccacagagatacaaacctcaggcaccacaacaatattcgccggccacctgaaatgccgcttaaaaatggacaaactcactctcaaaggaatgagctacgtcatgtgcacaggctcattcaaactagagaaagaagtcgcagaaacccaacacggcaccgtcctagtccaaataaaatacgaaggaaccgacgcaccatgcaaaatcccattctccacccaggacgaaaaaggcgtcacccaaaacggacgccttatcacagccaatcccatcgtcaccgacaaagaaaagccagtaaacatcgaagcagaacccccattcggcgaatcatacatcgtcatcggggcaggggaaaaggccctcaaactttcatggttcaagaaaggatccagcatcggaaaaatgttcgaagcgacagcccgaggcgcacgccggatggccatcctcggagacacagcatgggacttcggcagcatcggcggagtctttacatccgtcggaaagctagtacaccagatctttggcacagcatacggagtccttttctcaggcgtaagctggacgatgaaaataggcataggcgtactattaacctggctaggcctcaactcaaggtccacaagcctgtccatgacatgtatagcagtgggcctcgtcaccctctacctcggcgtaatggtgcaagcctaa

SEQ ID NO: 2360 - RNA, 2043 nt, synthetic construct
  misc_feature 1..2043: note = derived and/or modified CDS sequence (opt11) from DENV-1 CYD23__SSopt-pr(D104A)MEdelstem_TM,(F108S)-JEV
  source 1..2043: mol_type = other RNA
atgaaaagaaagaaatcagtaacaatgttactcatgctcatgccaacggccctggcgttccacctaacaacgcgcggaggggaaccgcacatgattgtctcgaaacaagaaagaggaaaaagcctcctgttcaaaacgagcgcgggcgtgaacatgtgcaccctcatagccatggacctgggcgaactctgcgaggacaccatgacctacaaatgccccaggataacggaagcagaaccagatgacgtcgactgctggtgcaatgccaccgacacatgggtaacctacggaacctgctcacaaacgggcgaacacagacgcgccaaacggagcgtcgcactagcaccgcacgtgggactaggactagaaacccgcacagaaacgtggatgagcagcgaaggagcctggaaacagatacaacgcgtagaaacatgggcactacgacaccccggatttaccgtaatagcactattcctcgcgcacgcaatcggtacatccattacgcaaaaaggcataatcttcatcctgctaatgctagtaacaccatccatggccatgcggtgcgtcgggatcggtagtcgagacttcgtcgaaggcctaagcggagccacatgggtagacgtcgtacttgaacacggaagctgcgtaaccaccatggcaaaagacaaacccaccctcgacatagaactactaaaaacagaagtcacgaaccccgccgtactaagaaaattatgtatcgaagcgaagatcagcaacacaaccaccgacagcagatgtccgacacaaggagaggccacgctcgtagaagaacaggacgccaacttcgtatgcaggagaacattcgtggaccggggctggggcaacggatgcggcctatccggaaaaggaagtctgataacgtgcgcaaaattcaagtgcgtaacgaaactagaaggaaaaatagtgcagtacgagaacctaaagtatagcgtaatcgtaacagtacacaccggagaccaacatcaagttgggaacgaatctactgaacacgggacaacagccacaatcacaccccaagcgccaaccacggaaattcagctgaccgactacggagccctcacactcgactgcagcccacgcacaggactcgacttcaacgaaatggtgctactcacaatgaaagagaaatcgtggctagtccacaaacagtggttcctcgacctcccgctaccatggacgagcggagcatcaacaagtcaagaaacttggaacaggcaagacctcctggtaaccttcaagactgcacacgcaaagaaacaagaggtggtggtactgggatcccaagagggagcgatgcacaccgcactgacaggcgcgaccgagatccagacatcgggaaccacgacgatcttcgcaggacacttgaaatgtcggctaaaaatggataaactcacactcaaaggcatgagctacgtcatgtgcacaggcagcttcaaactcgaaaaagaagtcgcggaaacccaacacggtacagtcctcgtccaaatcaaatacgaaggtaccgacgcgccttgcaaaataccattctcaacacaagacgaaaaaggcgtcacccaaaacggacgactgatcaccgccaaccccatagtaacggacaaagaaaaacccgtaaacatcgaagccgaaccgcccttcggcgagagctatatagtcatcggagctggagaaaaagccctgaaactgagctggttcaagaaagggagcacgctcgggaaagcattctcaacaacgctgaagggcgcacaacgactagccgccctaggagacacagcgtgggacttcggcagcataggaggagtattcaactcgatcggacgcgcggttcaccaagtgttcggaggcgccttcagaaccttattcggaggaatgtcatggatcacccaaggactcatgggcgcactcttactctggatgggagtcaacgcgagggacagaagcatcgcactagccttcctggcgacagggggagtactcgtattcctggccacaaacgtacacgcgtaa

SEQ ID NO: 2361 - RNA, 2043 nt, synthetic construct
  misc_feature 1..2043: note = derived and/or modified CDS sequence (opt11) from DENV-1 CYD23__SSopt-prMEdelstem_TM,(H261N)-JEV
  source 1..2043: mol_type = other RNA
atgaaacgcaaaaagtcagtcaccatgctgctaatgctcatgcccaccgcactagcgtttcacctcacaaccagaggtggagaaccacacatgatagtcagtaaacaggaaagaggcaagagcttactcttcaagacctccgcaggcgtaaacatgtgcactctcatagcgatggacctcggcgaactctgcgaagacaccatgacctacaaatgtccccgaatcaccgaagcagaacccgatgatgtcgactgctggtgcaacgcgacggacacatgggtgacatacggcacgtgcagccaaacaggcgaacacagacgcgacaaacgaagcgtagccctagccccacacgttggcctaggcctagaaacacgaacagaaacgtggatgagttccgaaggagcctggaaacaaatccaacgcgtagaaacctgggcgctaaggcacccaggcttcaccgtaatagcactcttcctcgcacacgcaatcggcaccagcataacacaaaaggggataatattcatcctactcatgctggtcacgccatcaatggcaatgcgatgcgttggaataggcagcagagacttcgtagagggcctaagcggcgcaacatgggtcgacgtagttctcgaacacgggtcatgcgtgacaacaatggcgaaagacaagccaaccctggacattgaactgctcaagacagaagtcaccaaccccgccgtcctaagaaaactatgcatagaagcgaagataagcaacaccacaaccgacagccggtgcccaacccaaggcgaggccaccctagtcgaagaacaagacgccaacttcgtatgccgacgaacattcgtagaccgcggctggggtaacggctgcggcctcttcggaaaaggaagtctcatcacatgcgcaaaattcaagtgcgtaacaaaactcgagggaaagatagtacaatacgaaaacctcaagtactcagtcatagtcacagtccacacaggcgaccaacaccaagtcggaaacgaaagcaccgaacacgggacaacggccacaatcacaccccaagccccaaccaccgaaatccaactgacagactacggagcactcaccctggactgtagcccccgaaccggactagacttcaacgaaatggtactcctcaccatgaaagaaaaatcctggctcgtacacaaacaatggttcctcgacctgcccctgccttggaccagcggcgcgtcaacgtcacaagagacctggaaccgccaagacctcctagtaacgttcaaaaccgcacacgcgaaaaagcaagaagtcgtggtcctaggcagccaagagggagcaatgaacacagcactaacaggagcaaccgaaatccaaacatcaggaacaaccacaatctttgccggccacctaaagtgcagactaaaaatggacaaattgacactgaaaggaatgagctacgtcatgtgcacaggatcattcaagctcgagaaagaagtcgccgaaacacaacacgggaccgtgctagtacaaataaaatacgagggaacagacgcgccctgcaaaatcccattcagtacgcaagacgagaaaggagtaacccaaaacgggcgactcatcacggcaaacccaatagtaaccgacaaagaaaaacccgtgaacatagaagccgaacccccattcggggagagctacatcgtaatcggagccggagaaaaagcactaaaactaagctggttcaagaaaggatccaccctagggaaagcattctcgaccacactaaaaggagcacaaagactggcagccctaggcgacaccgcatgggacttcggcagcatcgggggcgtcttcaacagcatcggacgagccgtacaccaagtattcggcggggctttccgcaccctgttcgggggaatgagttggataacccaaggactaatgggcgccctactcctctggatgggcgtaaacgcaagagacagaagcatagccctggcgttcctagccacaggcggggtgctagtattcctcgccacgaacgtacacgcatga

SEQ ID NO: 2362 - RNA, 2043 nt, synthetic construct
  misc_feature 1..2043: note = derived and/or modified CDS sequence (opt11) from DENV-1 CYD23__SSopt-prMEdelstem_TM,(R188L,A267T)-JEV
  source 1..2043: mol_type = other RNA
atgaaacgcaagaaatccgtcaccatgctactaatgctaatgcccacggccctggcattccacctgaccacgcgcggcggcgagcctcatatgatcgtaagcaaacaagaacgaggcaaaagcctactcttcaaaacaagtgccggagtgaacatgtgcacgctcatagctatggacctcggcgaactttgtgaagacaccatgacctacaaatgccccagaataaccgaagccgaaccggacgacgtcgactgctggtgcaacgcaacggacacatgggtaacctacggaacctgctcgcagacgggcgagcaccgccgcgacaaacgatcagtcgccctcgccccgcacgtgggactgggactggaaacccgcacagagacgtggatgagttcagaaggggcatggaaacaaatccaacgcgtagaaacctgggcactcagacaccccggattcacagtgatcgcactttttctcgcacacgccatcggaacatcaataacacagaagggaataatcttcatcctcctcatgttagtgaccccatcaatggccatgcgctgcgtagggataggtagcagagacttcgtcgagggactaagcggagccacatgggtagacgtcgtcctagaacacggctcctgcgtaacaacaatggccaaggacaaaccaaccctagacatagaactgctaaaaacagaggtaacgaacccagcagtcctaagaaaactgtgcatagaagcaaaaataagcaacacgactaccgatagccgctgcccgacgcaaggcgaagccacactggtcgaggagcaagacgcaaacttcgtatgccgacgcacgttcgtggaccggggctggggaaatggatgcggcctattcggaaaagggagcctaatcacgtgcgcgaaattcaaatgcgtcacgaaactggaagggaaaatcgtccaatacgaaaacctgaaatacagcgtcatcgtgaccgtacacacaggagaccaacaccaagtgggcaacgaaagcaccgaacacggcacaactgccacgataacaccccaagcacccaccacagaaatccaactaactgattacggcgccttaaccctcgactgttcaccactcacgggcctagacttcaacgaaatggtgctattaactatgaaagagaaatcatggctggtccacaaacaatggttcctagacctcccactcccctggaccagcggagcatcaacttcacaagagacctggaaccggcaagatctcctcgtcaccttcaaaaccgcacacgccaaaaagcaagaggtcgtggtgctaggcagtcaagagggagcaatgcacaccgcgctaacaggcacgacagaaatccaaacatcaggaacgacaacaatattcgccggacacctaaaatgccgccttaaaatggacaagctcaccctaaagggaatgagctacgtcatgtgtacaggatcgttcaagctggaaaaagaagtagcagagacacaacatggaacagtactcgtccaaatcaaatacgagggtacggacgcaccatgcaagataccctttagcacacaagacgaaaaaggcgtcacccaaaacgggcgactcataacggcaaatccaatagttacagacaaagaaaagcccgtaaacatagaagcggaaccacccttcggcgaaagctatatcgtcatcggagccggggaaaaagcactaaaactgagctggttcaagaaaggaagcacgctaggcaaagcgttctcaaccacactcaaaggagcacaaagactcgccgcactaggcgacaccgcatgggacttcggaagcatcggcggcgtcttcaactcaatcggacgcgcggttcaccaagtcttcgggggcgcattccgaaccctgttcggcggcatgagctggatcacccaaggactaatgggagcactcctactctggatgggagtcaatgcacgagacaggagcatagcactggccttcctagcaacagggggagtgctagtgttcctagcgacgaacgtccacgcataa

SEQ ID NO: 2363 - RNA, 300 nt, synthetic construct
  misc_feature 1..300: note = derived and/or modified CDS sequence (opt11) from DENV-2 CYD2-T__C
  source 1..300: mol_type = other RNA
atgaacaaccaacgcaaaaaagccaaaaacacccccttcaacatgctcaaacgcgaacgcaaccgcgtctccaccgtccaacaactcaccaaacgcttctccctcggcatgctccaaggccgcggccccctcaaactcttcatggccctcgtcgccttcctccgcttcctcaccatcccccccaccgccggcatcctcaaacgctggggcaccatcaaaaaatccaaagccatcaacgtcctccgcggcttccgcaaagaaatcggccgcatgctcaacatcctaaaccgccgccgccgc

SEQ ID NO: 2364 - RNA, 342 nt, synthetic construct
  misc_feature 1..342: note = derived and/or modified CDS sequence (opt11) from DENV-2 CYD2-T__C-SSc
  source 1..342: mol_type = other RNA
atgaacaaccaacgcaaaaaagccaaaaacacccccttcaacatgctaaaacgcgaacgcaaccgcgtctcaaccgtccaacaactcaccaaacgcttctccctcggcatgctccaaggccgcggccccctcaaactcttcatggccctcgtcgccttcctccgcttcctcaccatcccccccaccgccggcatcctcaaacgctggggcaccatcaaaaaatccaaagccatcaacgtcctccgcggcttccgcaaagaaatcggccgcatgctcaacatcctcaaccgccgccgccgctccgccggcatgatcatcatgctcatccccaccgtcatggcc

SEQ ID NO: 2365 - RNA, 273 nt, synthetic construct
  misc_feature 1..273: note = derived and/or modified CDS sequence (opt11) from DENV-2 CYD2-T__pr
  source 1..273: mol_type = other RNA
ttccacctaaccaccagaaacggcgaaccccacatgatagtctcccgccaagaaaaaggcaaaagcctactcttcaaaacagaagacggcgtcaacatgtgcacactcatggccatggacctcggcgaactctgcgaagacaccataacctacaaatgccccctactcagacaaaacgaaccagaagacatcgactgctggtgcaacagcaccagcacctgggtcacctacggcacatgcaccaccatgggcgaacacagacgcgaaaaacgc

SEQ ID NO: 2366 - RNA, 225 nt, synthetic construct
  misc_feature 1..225: note = derived and/or modified CDS sequence (opt11) from DENV-2 CYD2-T__M
  source 1..225: mol_type = other RNA
tccgtcgccctcgtcccccacgtcggcatgggcctcgaaacccgcaccgaaacctggatgtcctccgaaggcgcctggaaacacgtccaacgcatcgaaacctggatcctccgccaccccggcttcaccatgatggccgccatcctcgcctacaccatcggcaccacccacttccaacgcgccctcatcttcatcctcctcaccgccgtcaccccctccatgacc

SEQ ID NO: 2367 - RNA, 498 nt, synthetic construct
  misc_feature 1..498: note = derived and/or modified CDS sequence (opt11) from DENV-2 CYD2-T__prM
  source 1..498: mol_type = other RNA
ttccacctcaccacccgcaacggcgaaccccacatgatcgtatcccgccaagaaaaaggcaaatccctcctcttcaaaaccgaagacggcgtcaacatgtgcaccctcatggccatggacctcggcgaactctgcgaagacaccatcacctacaaatgccccctcctccgccaaaacgaacccgaagacatcgactgctggtgcaactccacctccacctgggtcacctacggcacatgcaccaccatgggcgaacaccgccgcgaaaaacgctccgtcgcactcgtcccccacgtcggcatgggcctcgaaacccgcaccgaaacctggatgtcatccgaaggcgcctggaaacacgtccaacgcatcgaaacctggatcctccgccaccccggcttcaccatgatggccgccatcctcgcctacaccatcggcacaacccacttccaacgcgccctcatcttcatcctactcaccgccgtaaccccatccatgacc

SEQ ID NO: 2368 - RNA, 1485 nt, synthetic construct
  misc_feature 1..1485: note = derived and/or modified CDS sequence (opt11) from DENV-2 CYD2-T__E
  source 1..1485: mol_type = other RNA
atgagatgcatagggatgtcgaacagagacttcgtagaaggggtaagcggagggtcgtgggtggacatagtcctggaacacggaagctgcgtgacaacaatggcgaaaaataagccgacactagacttcgagttgatcaagacagaggccaagcagccagcaacgctgagaaaatactgcatagaagcaaaactgaccaacacaacgacagagagcagatgcccgacacagggagaaccctcactaaacgaggagcaagacaaacgcttcgtatgcaaacacagcatggtggacagaggctgggggaacggctgcggcctattcgggaagggaggcatagtaacgtgcgcaatgttccgctgcaagaaaaacatggaaggaaaagtcgtacagccggaaaacctcgaatacacaatagtaatcacaccacattcaggcgaggagcacgccgtggggaacgacacggggaaacacgggaaagagatcaagataacaccccagagcagtataacggaagcggaactaaccggatacggaaccgtgaccatggaatgcagtccgcgaacggggctggacttcaacgagatggtgctcctgcaaatggagaacaaagcgtggctggtacaccggcagtggttcctcgacctaccgctcccatggctacccggggccgacacacaagggtcgaactggatacagaaagaaacactggtcacattcaaaaacccgcacgcgaaaaagcaagacgtagtagtactaggaagccaagagggagcgatgcacaccgcactaacaggagcgacggagatccagatgagcagcgggaacctgctattcaccgggcacctgaagtgccgcctgcgcatggacaagctccagctcaaagggatgagctacagcatgtgcacaggcaagttcaaggtcgtgaaggagatcgcggaaacccaacacggcacgatcgtgatcagggtgcaatacgaaggcgacggctcgccatgcaaaatacccttcgaaataatggatctcgagaaacggcacgtgctcggaagactgataacggtcaaccccatagtcacagaaaaggactcacccgtaaacatcgaagcggaaccgccattcggcgatagctacatcataataggggtagaaccaggacaactgaaactaaactggttcaagaaagggagcagcataggacaaatgttcgaaaccacgatgaggggagcgaagagaatggcaatcttgggagacaccgcatgggacttcggaagcctcggaggggtgttcacatcaatagggaaagcgctacaccaagtgttcggggccatatacggggccgcgttctcgggagtgagctggacaatgaagatcctcatcggagtgatcataacatggatcgggatgaacagcagatcgacgagcttgagcgtgacactggtcttggtagggatcgtgacattgtacttgggcgtgatggtgcaagcc

SEQ ID NO: 2369 - RNA, 1983 nt, synthetic construct
  misc_feature 1..1983: note = derived and/or modified CDS sequence (opt11) from DENV-2 CYD2-T__prME
  source 1..1983: mol_type = other RNA
ttccacctaacaacacgaaacggcgaaccccatatgatagtgtcacgccaagaaaaggggaaaagtctactctttaaaaccgaagacggagtcaacatgtgcacacttatggccatggacctaggagaactatgcgaagacacaatcacatataaatgccccctcctgagacaaaacgaaccagaagacatcgactgctggtgcaacagtaccagcacgtgggtcacttacggcacatgcactacaatgggagaacaccgccgagagaaaaggtccgtcgccctcgtcccacacgtcggaatggggctcgaaacccgaaccgaaacctggatgtcctcagaaggcgcctggaaacacgtccagcgaatagaaacatggatcctacgccatccagggttcaccatgatggcggccatactagcatacacaattggcacgacacacttccaaagagccctcatattcatcctactcaccgccgtcaccccaagcatgacaatgcgctgtatcggaatgtcgaaccgagacttcgtcgaaggggtaagcgggggatcatgggtagacatagtactggaacacggatcatgcgtaacaacgatggccaaaaacaagcccacactcgattttgaactcatcaaaaccgaagccaagcaacccgccacactccgcaaatactgcatagaagccaaactgaccaacaccaccaccgaaagcagatgccccacccaaggagaaccaagcctcaacgaggaacaagacaaaagattcgtatgcaaacactcaatggtagatcgcggatgggggaacggctgcggcctcttcggaaaaggaggaatagtaacctgcgcgatgttccgatgcaaaaagaacatggaaggcaaagtcgtccaacccgaaaacctagaatacaccatcgtcataaccccacacagcggagaggaacatgcggtcggcaacgacacagggaaacacggaaaagagataaaaataacaccacaatcaagcatcacagaagcagaactaacaggctacggcaccgtaacaatggaatgctccccacgcacaggactcgactttaacgagatggtactcctgcaaatggaaaacaaggcttggctcgtccaccgccagtggttcctagacctgccactcccatggctacccggcgccgacacccaaggctcgaactggatccaaaaagagaccctcgtaaccttcaaaaacccgcacgccaagaaacaagacgtcgtagtcctcggctcccaagaaggcgcaatgcacaccgcactcacaggcgccacagaaatccaaatgtcctcaggaaacctcctattcactggccacctcaaatgccgcctccgcatggacaaactacaactcaaaggcatgagctactcaatgtgcacagggaaattcaaagtagtaaaagagatagccgagactcagcacggcacaatagtgatccgggtgcaatacgagggggacggcagcccctgcaaaatcccatttgaaataatggacctagagaaacgccacgtactcggccgcctaatcaccgtcaaccccatcgtcaccgaaaaagatagcccagtgaacatagaagcagagcccccgttcggcgacagctacatcataatcggcgtagaacccggacaactcaagctcaactggttcaagaaaggctcatcaatcggccaaatgttcgaaactaccatgagaggagccaagcgcatggcaatcctaggcgacaccgcctgggatttcggatccctaggaggcgtattcacatcaatcggaaaagcactccaccaagtcttcggcgccatctacggcgcagccttcagcggcgtcagctggaccatgaaaatccttatcggcgtgataataacatggatcggcatgaacagtcgcagtacaagtctaagcgtaaccctcgtactcgtaggcatcgtcaccctgtatctaggcgtcatggtccaagcc

SEQ ID NO: 2370 - RNA, 2025 nt, synthetic construct
  misc_feature 1..2025: note = derived and/or modified CDS sequence (opt11) from DENV-2 CYD2-T__SSc-prME
  source 1..2025: mol_type = other RNA
agcgccggaatgatcataatgctgataccgaccgttatggccttccacctaactacacggaacggcgaaccccacatgatcgtgtccaggcaagaaaaaggcaaaagcctactcttcaaaacagaagacggagtcaacatgtgcaccctcatggccatggacctaggagaactatgcgaagacacaatcacatacaaatgcccactactccgacaaaacgaacccgaagacatagactgctggtgcaacagcacgtcaacctgggtcacctacggaacctgcacaaccatgggcgaacaccgccgagaaaaacgcagcgtagcactcgtgccacacgtaggcatgggactagagacccgcacggaaacatggatgagctcagaaggcgcctggaaacacgtgcaaaggatagaaacctggatactacgccaccccgggttcaccatgatggccgcgatcctggcatataccataggtaccacacacttccaacgagccctcatattcatactactaacagccgtaacgccctccatgacgatgcgctgcatcggcatgagcaacagagacttcgtcgaaggcgtaagcggaggaagttgggtcgacatcgtcctcgaacacggcagctgcgtcaccaccatggccaaaaacaaaccgacactagacttcgaactcatcaaaaccgaagcaaaacaaccggccaccctcagaaaatactgcattgaagccaagctaacgaacacaactacagaaagcagatgcccaacccagggagaaccatcactcaacgaggaacaggacaaacgattcgtctgcaaacacagcatggtcgacagaggctggggaaacgggtgcggcctattcggcaaaggaggaatagtcacgtgcgccatgttccggtgcaagaaaaacatggaaggcaaagtagtccaaccggaaaacctggaatacacgatagtcatcacaccccactctggcgaagaacacgccgtcggcaacgacacggggaaacacggaaaagaaattaaaatcacaccccagtcgagcatcaccgaagcggaactgactggctacgggaccgtcacaatggaatgctccccacgaaccggcctagacttcaacgagatggtcctcctgcaaatggagaacaaagcatggctcgtccaccgacagtggttcctcgaccttccactcccgtggctccccggcgcggacacacaaggctcaaattggatccaaaaagaaaccctagtcaccttcaaaaacccacacgccaagaaacaggacgtcgtagtcctaggttcacaagaaggggccatgcacaccgccctgaccggagccacagaaatacaaatgtcctccggaaacctcctattcaccgggcacctgaaatgccggttacgaatggacaaactacaactaaagggaatgtcatactccatgtgcacaggaaaattcaaagtcgtcaaagaaatcgccgagacccaacacggaactatagtcatccgggtccaatacgagggagacggaagcccgtgcaagatccccttcgaaataatggacctcgaaaaacgccacgtactaggacgactaataaccgtcaatccaatcgtaacagagaaggacagtcccgtcaacatcgaagcagagccaccattcggagacagctacatcatcatcggagtagaaccgggccaactgaaacttaactggttcaagaaaggcagcagcataggccaaatgttcgagacaacgatgcgaggcgcgaaacgaatggccatcctcggcgacacagcctgggatttcggatcactaggcggcgttttcacgagcataggcaaggccctacaccaagtattcggcgccatatacggggcggccttcagcggggtgagttggaccatgaaaatcctaataggcgtcatcataacctggataggcatgaactcccgctccacaagcctaagcgtgaccctagtactcgtaggtatcgtaacactctacctcggcgtgatggtacaagcc

SEQ ID NO: 2371 - RNA, 2325 nt, synthetic construct
  misc_feature 1..2325: note = derived and/or modified CDS sequence (opt11) from DENV-2 CYD2-T__C-prME
  source 1..2325: mol_type = other RNA
atgaacaaccaaagaaagaaagccaaaaacaccccattcaacatgctaaagcgcgagcggaaccgcgtaagcacagtacaacaactaaccaaacgcttctcactaggcatgctacaaggacgcggccccctaaaactattcatggcgctcgtagcgttcctgagattcctcacaataccacccacagccggcatactcaaacgatggggaaccatcaagaaatcaaaagccatcaacgtgctacgaggcttcaggaaagagatcggacgcatgctaaatatactcaaccggcgaagacgctccgcaggcatgataatcatgctcatccccaccgtaatggcgttccacctgaccacacgaaacggagaaccccacatgatcgtctcaagacaggaaaaaggaaaaagcctcctgttcaaaacagaagacggggtaaacatgtgcacgctcatggccatggaccttggcgagctatgcgaggacaccatcacctacaaatgcccactgctccgccagaacgaaccagaagacatagactgctggtgcaacagcacaagcacgtgggtaacctacgggacgtgcacaaccatgggagagcaccgccgcgagaaacgaagcgtggccctagtcccgcacgtgggcatgggactcgaaacacgaaccgagacatggatgtcctccgaaggagcctggaaacacgtccaacgcatagaaacgtggatactgaggcacccaggcttcaccatgatggcagccatactcgcatacacaatcggcaccacacacttccaaagagccctgatcttcatcttactaacagctgtgaccccaagcatgaccatgagatgcataggcatgtcgaacagggacttcgtcgaaggcgtatccggcggctcgtgggtggacatcgtcctggaacacggctcctgcgtcacgacaatggcgaaaaacaagcccaccctcgactttgaactgatcaaaaccgaagcaaagcaaccagctacactcagaaaatactgcatagaagcgaaactaaccaacacgacgacagaaagcagatgcccgacccaaggcgaaccctcactcaacgaggaacaagataaacgattcgtctgcaaacacagcatggtcgacagaggatggggaaacggctgcggcctcttcggcaaaggaggaatagtaacgtgcgcaatgttccgatgcaagaaaaacatggagggaaaagtagtccaaccggaaaacctcgaatacacaatcgttataacaccgcactccggcgaggagcacgcagtggggaacgacacaggaaaacacggaaaagaaataaaaatcacaccccaaagctccatcacagaagccgaactaaccggctacggaaccgtaacaatggaatgcagcccccgaacagggctagacttcaacgaaatggtgctattgcaaatggaaaacaaagcatggctcgtccaccgccaatggttcctcgacctaccgctaccctggctaccaggcgccgacacgcaaggatcaaactggatacagaaagaaaccctcgtaaccttcaaaaacccacacgcaaagaaacaagacgtagtggtactcggaagccaagaaggcgcgatgcacaccgctctcactggcgccacagaaatccagatgtcgtcgggaaacctcctgttcacaggccacctaaaatgccgcctacgcatggataaactacaactcaaaggcatgagctacagtatgtgcaccggcaagttcaaggtggtcaaagaaatcgcggaaacccaacacggcacaatagttatcagagtccaatacgaaggcgacggctcaccctgcaaaataccattcgagataatggacctcgagaaacgccacgttctaggccgcctaatcacagtaaaccccatcgtcacggaaaaagactcacccgtcaacatcgaagccgagccgcccttcggagatagctacataatcatcggcgttgaaccaggacaactaaaactgaactggttcaagaaaggcagctccataggccaaatgttcgagacaacgatgcgaggcgcaaaacgcatggccattctcggcgacaccgcctgggacttcggctccctgggcggagtgttcacgtccatcggcaaagccctccatcaagtattcggagcaatatacggcgctgccttctcaggggtcagctggaccatgaaaattctcataggcgtcataataacctggataggaatgaactccagaagcacatccctatcagtaaccctagtcctagtaggaatcgtcaccctctaccttggagtcatggtacaagca

SEQ ID NO: 2372 - RNA, 45 nt, synthetic construct
  misc_feature 1..45: note = derived and/or modified CDS sequence (opt11) from DENV-2 CYD2-T__SSc
  source 1..45: mol_type = other RNA
atgagcgcgggcatgatcataatgttgatcccgaccgtgatggcg

SEQ ID NO: 2373 - RNA, 57 nt, synthetic construct
  misc_feature 1..57: note = derived and/or modified CDS sequence (opt11) from DENV-2 CYD2-T__SSopt
  source 1..57: mol_type = other RNA
atgaaaaggaaaaagagcgcgggcatgatcataatgttgatcccgaccgtgatggcg

SEQ ID NO: 2374 - RNA, 57 nt, synthetic construct
  misc_feature 1..57: note = derived and/or modified CDS sequence (opt11) from DENV-2 CYD2-T__SSm
  source 1..57: mol_type = other RNA
atgttccaacgcgccctcatcttcatcctcctcaccgccgtcaccccctccatgacc

SEQ ID NO: 2375 - RNA, 1488 nt, synthetic construct
  misc_feature 1..1488: note = derived and/or modified CDS sequence (opt11) from DENV-2 CYD2-T__E
  source 1..1488: mol_type = other RNA
atgcgctgcatcggaatgtcgaaccgcgactttgtcgaaggcgtcagcggaggctcctgggtcgacatagtcctcgaacacggctcttgcgtaaccaccatggccaaaaacaaaccgaccctagacttcgaactcatcaaaacagaggcaaaacaacccgccaccctccggaaatactgcatagaagcaaaactaaccaacacaactaccgaaagtcgctgcccgacccaaggcgaaccatcgctaaacgaagaacaagacaaacggttcgtatgcaaacacagcatggtcgaccgcggctggggcaacggctgcggcctattcggaaaaggcggcatagtaacctgcgcgatgttccgctgcaaaaagaacatggagggcaaagtcgtccaaccagaaaacctagaatacaccatcgtcataacaccccactccggcgaagaacacgccgtgggcaacgacaccggcaaacacggcaaagagataaaaatcacaccacaatcctcaataacagaagcagaactcacgggatacggcacagtcacaatggagtgcagcccacgcaccggcctggacttcaacgaaatggtcctactccaaatggaaaacaaagcatggctcgtacaccgacaatggttcctcgacctcccactcccatggctgcccggagccgacacacaaggatccaactggatccaaaaagaaaccctagtcacattcaaaaacccccacgcgaagaaacaagatgtagtcgtcctcggcagccaagagggcgcaatgcacaccgcactcaccggcgcaaccgagatccaaatgagcagcgggaacctactattcaccggacacctcaaatgccgcttacgaatggacaaactgcaactaaaaggcatgagctactccatgtgcacaggaaaattcaaagtcgtaaaagaaatcgccgaaacacagcacggaaccatcgtaatcagagtccaatacgaaggagacggctcaccctgcaaaatacccttcgaaataatggacctcgaaaaacgacacgtcctaggacgtctcatcaccgtcaacccaatagtcaccgaaaaagactcaccagtcaacatcgaagccgaacccccattcggcgacagctacatcatcataggcgtagaaccaggacaactcaaactaaactggttcaagaaaggatctagcatcggccaaatgttcgaaaccaccatgcgcggagccaaacggatggccatcctcggagacacagcatgggatttcggcagtctcggcggagtattcacatccatcggcaaagccctccaccaagtattcggcgcgatatacggcgccgcattctccggcgtaagctggaccatgaaaatcctaatcggcgtcatcataacatggatcggcatgaactcccgaagcacgagcctcagcgtaaccctagtcttagtcggcatcgtcacactgtacctaggcgtaatggtccaagcataa

SEQ ID NO: 2376 - RNA, 1182 nt, synthetic construct
  misc_feature 1..1182: note = derived and/or modified CDS sequence (opt11) from DENV-2 CYD2-T__EdelTM-variant (aa1-394)
  source 1..1182: mol_type = other RNA
atgagatgcataggcatgtcaaacagagacttcgtggaaggcgtatccggaggaagctgggtggacatcgtactagaacacggcagctgcgtaaccaccatggccaaaaacaaacccaccctcgacttcgaactaataaaaacagaagcaaaacaaccagccaccctacgcaaatactgcatcgaagccaaactcaccaacacaacgacagaaagccgctgccccacacaaggcgaacccagcctcaacgaagaacaagacaagcgattcgtctgcaaacactcaatggtcgaccgcggctggggcaacggctgcggactcttcggcaaaggcggcatcgtaacatgcgccatgttccgctgcaagaaaaacatggaaggcaaagtagtacaacccgaaaacctcgaatacaccatagtcatcaccccacacagtggagaagaacacgcagtcggcaacgacacaggcaaacacggcaaagaaatcaaaatcacaccccagtcctcaataaccgaagcggaactaaccggctacggcaccgtaaccatggaatgctcaccccgcaccggactagacttcaacgagatggtactcctacaaatggaaaacaaagcctggctcgtccaccgacaatggttcctcgacctacccctcccctggctccccggcgcggacacacaaggctccaactggatccaaaaagaaacactcgtcaccttcaaaaacccccacgccaagaaacaagacgtagtcgtcctgggaagccaagaaggagccatgcacacggccctgacaggagcgaccgaaatccagatgagctccggaaacctcctcttcaccggccacctcaaatgccgcctccgaatggacaaactacaactaaaaggaatgagctacagcatgtgcacaggcaaattcaaagtagtaaaagaaatagccgaaacccaacacggcaccatcgtcatccgcgtacaatacgaaggcgacggcagcccatgcaaaatcccattcgaaatcatggacctagagaaacgacacgtcctaggacgcctcataaccgtcaacccaatagtcaccgaaaaagacagccccgtcaacatcgaagcagaaccacccttcggcgacagctacataatcataggcgtcgaacccggccaactcaaactaaactggttcaaaaag

SEQ ID NO: 2377 - RNA, 1272 nt, synthetic construct
  misc_feature 1..1272: note = derived and/or modified CDS sequence (opt11) from DENV-2 CYD2-T__EdelTM-variant (aa1-424)
  source 1..1272: mol_type = other RNA
atgcgctgcatcggaatgagcaaccgcgacttcgtcgaaggagtcagcggcggatcctgggtcgacatagtcctcgaacacggctcctgcgtaaccactatggccaaaaacaaacccaccctcgacttcgagctaataaaaacagaagccaagcagcccgcaaccctacgcaagtactgcatagaagccaaactcacgaacaccaccacagaaagccgatgccccacacaaggcgaacccagcctcaacgaagaacaggacaaaagattcgtctgcaaacacagcatggtcgaccgaggatggggcaacggctgcggcctgttcggaaaaggcggaatcgtaacatgcgccatgttccgatgcaaaaagaacatggaaggcaaggtcgtccaaccagaaaacctagaatacaccatcgtaatcacaccacacagcggagaagaacacgcagtcggcaacgacaccggcaaacacggcaaagaaatcaaaatcaccccacaaagctcaatcacagaagctgaactaaccggctacggaacagtaaccatggaatgcagcccccgaaccgggctagacttcaacgaaatggtcctcctacaaatggaaaacaaagcatggctagtccaccgacaatggttcctcgacttacccctaccctggctaccaggcgccgacacccaaggctcaaactggatccaaaaagaaacactcgtaacattcaaaaacccccacgccaagaaacaagacgtcgtagtcttaggaagccaagaaggcgccatgcacacagccctaacaggcgcaaccgaaatacaaatgtcaagcggcaacctcctcttcacaggccacctcaaatgcagactccggatggacaagctgcagctgaaaggcatgtcatactcaatgtgcaccggaaaattcaaggtagtaaaagagatcgcagaaacccaacacggaaccatcgtcatccgcgtacaatacgaaggcgacggctccccctgcaaaatacccttcgaaataatggacctagaaaaacgtcacgtcctcggccgactaatcaccgtcaaccccatcgtcacagaaaaagactcaccagtaaacatagaagccgaaccacccttcggagactcatacataataataggagtcgagcccggacaactcaaactaaactggttcaagaaaggaagcagcatcggccagatgttcgaaaccaccatgcgaggagcaaaacgcatggcgatcctaggcgacaccgcctgggacttcggctcc

SEQ ID NO: 2378 - RNA, 1263 nt, synthetic construct
  misc_feature 1..1263: note = derived and/or modified CDS sequence (opt11) from DENV-2 CYD2-T__EdelTM-variant (aa1-421)
  source 1..1263: mol_type = other RNA
atgcgctgcataggcatgagcaacagagacttcgtcgaaggagtcagcggaggcagctgggtagacatcgtactagaacacggaagctgcgtaacaaccatggccaaaaacaaacccacccttgacttcgaactcataaaaacagaagcaaaacagcccgcgaccctacgaaaatactgcatagaggccaaactcaccaacaccaccacggaaagccgctgcccaacacagggcgaaccaagcctcaacgaggaacaagataaacgcttcgtctgcaaacacagcatggtcgaccgcggatggggcaatggatgcggcctcttcgggaagggcgggatagtaacctgcgccatgttcagatgcaagaaaaacatggaaggcaaagtcgtccaaccagaaaacctcgaatacacaatcgtaatcacaccccacagcggggaagaacacgcagtaggaaacgacaccggcaaacacgggaaagaaataaaaataaccccacaaagctcaataaccgaagccgaactaaccggatacggcaccgtcacaatggaatgctcaccccgaaccggactagacttcaatgaaatggtactcctacaaatggaaaacaaagcctggctcgtgcaccgacaatggttcctcgacctaccgctcccatggctacccggagcggacacccaaggaagcaactggatccaaaaagaaaccctagtaaccttcaaaaacccccacgccaagaaacaagacgtcgtcgtactcggaagccaggaaggagcaatgcacaccgcgttaacaggagccacagagatccaaatgagcagcggaaacctactattcacaggccacctcaagtgcagactacgcatggacaaattacaactaaaaggcatgagctacagcatgtgcaccggaaaattcaaagtagtcaaggaaatcgccgaaacacaacacggaaccatagtcatacgcgtccaatacgaaggcgacggctcaccatgcaaaatccccttcgaaatcatggacctcgaaaagcgacacgtactcggccgactaataaccgtaaacccaatcgtgacagaaaaagacagcccagtcaacatcgaagcagaaccacccttcggcgactcatacatcatcataggcgtcgaacccgggcaactcaaactaaactggtttaagaaaggatccagcatcggacaaatgttcgaaacaaccatgagaggggcgaaacgcatggccatcctaggcgacaccgcctgggac

SEQ ID NO: 2379 - RNA, 2031 nt, synthetic construct
  misc_feature 1..2031: note = derived and/or modified CDS sequence (opt11) from DENV-2 CYD2-T__SSc-prME
  source 1..2031: mol_type = other RNA
atgtccgctggcatgataataatgctcatacccacagtcatggcattccacctaacaacgcgaaacggagaaccccacatgatcgtcagtcgccaagaaaaaggaaaaagcctcctcttcaaaaccgaagacggcgtcaacatgtgcactctcatggccatggacctaggtgaactctgcgaagacacgataacatacaaatgcccactgctacgacaaaatgaacccgaagacatcgactgctggtgcaacagcacatcaacctgggtcacatacggaacatgcacaacaatgggagaacaccgacgcgaaaagcgctccgtcgccctagtaccacacgtcggaatgggcctagaaactcgcacagaaacatggatgagctccgaaggcgcctggaaacacgtccagaggatagaaacgtggatactccgccaccccggcttcaccatgatggccgcaatcctcgcatacaccattggaaccacccacttccaacgcgccctaatcttcatactcctaacagccgtaacacccagcatgacaatgagatgcatcggaatgtccaaccgcgacttcgtcgagggcgtatccgggggatcatgggtcgacatcgtcctagagcacggctcctgcgtcactaccatggccaaaaacaaacctaccctagacttcgaactcataaaaacagaagcaaaacaacccgccaccctacgcaaatactgtatcgaagcaaaactcaccaacacgactactgaatcaagatgccccacacagggagaacccagccttaacgaggagcaagacaaacgtttcgtatgcaaacacagcatggtggacagaggctggggcaacggctgcggcctcttcggaaagggaggcatagtaacatgcgctatgttccgatgcaaaaagaacatggaaggcaaagtggtacaacccgaaaacctagaatatacaatcgtcataacaccccactcaggcgaagaacacgcggtaggaaacgacaccggcaaacacggcaaggaaatcaaaattacaccccagagttccatcaccgaggcggaactgacaggctacggcacagtcaccatggaatgcagcccacgcacaggcctagacttcaacgaaatggtcctcctccaaatggaaaacaaagcatggctcgtccaccgacagtggttcctcgacctacccctaccatggctccccggagcagacacccaggggagcaactggattcaaaaagaaacgctggtaaccttcaagaaccctcacgccaaaaagcaagacgtcgtcgtactcggcagccaagaaggcgcaatgcacaccgcactcaccggagccaccgaaatccaaatgtcgtcagggaaccttctcttcacaggccacctcaagtgccgcctccgaatggataaactacaactgaaaggcatgtcctacagcatgtgcaccggaaaattcaaagtcgtcaaagaaatcgcagagacacaacacggaaccatcgtaatacgggtccaatacgaaggggacggctcaccctgcaagatccccttcgagataatggacctcgagaaaagacacgtactcggccgcctcatcaccgtcaacccaatcgtcaccgaaaaggacagccccgtcaacatcgaggcagaaccacccttcggagacagctacataataataggagtcgaaccgggccaactcaagctcaactggtttaagaaagggagcagcatcggtcaaatgttcgaaaccacaatgagaggcgcaaaacggatggcaatcctaggagacacagcatgggacttcggaagcctaggcggagtcttcacgagcatcggcaaagcgctacaccaagtattcggcgccatatacggcgccgccttcagcggcgtcagctggacaatgaaaatcctaatcggcgtcataataacatggataggcatgaactcccgcagcacctcactcagcgtaacactcgtcctagtaggaatcgtaacactatacctaggagtgatggtacaagcataa

SEQ ID NO: 2380 - RNA, 2031 nt, synthetic construct
  misc_feature 1..2031: note = derived and/or modified CDS sequence (opt11) from DENV-2 CYD2-T__SSc-prME(F108S)
  source 1..2031: mol_type = other RNA
atgtcggccggaatgatcatcatgcttatccccaccgtcatggccttccacctcacaacacgtaacggggagccacacatgatcgtctcgagacaggaaaaaggcaagtcactactcttcaagacagaggacggcgtaaacatgtgcaccctcatggcgatggacctcggcgaactctgcgaagacaccataacatacaaatgccccctactacgccaaaacgaaccagaagacatcgactgctggtgcaacagcacatcaacctgggtaacgtacggaacgtgcacgaccatgggcgaacaccgacgagagaaaagaagcgtcgccctcgtcccccacgtgggcatgggactggaaactcgaacagaaacgtggatgtcctccgaaggcgcatggaaacacgtccaacgcatcgaaacctggatcctacgccaccccggattcacaatgatggccgcaatactggcatacacgatcggaacaactcacttccagcgcgcactcatattcattctcctcacagccgtaacccccagcatgaccatgcgatgcatcgggatgagcaaccgagacttcgtagaaggcgtaagcggaggcagctgggtggacatcgtcctcgaacacggctcgtgcgttaccacaatggccaaaaataagccaaccctagatttcgaactcatcaaaaccgaagcaaaacaaccagcaacactaaggaagtactgcatcgaagcaaaacttaccaacaccaccaccgaaagcagatgcccaacccaaggcgaaccatccctcaacgaggaacaagacaagagattcgtatgcaaacactccatggtcgaccgcggctggggcaacggctgcggactctcaggcaaagggggcatagtaacatgcgccatgttccgctgcaagaaaaatatggaaggcaaagtcgtccaacccgagaacctcgaatacacaatcgtcatcacaccccactcaggcgaggaacacgccgtcggcaacgacaccggcaaacacggtaaagaaataaaaatcacaccacaaagcagcattacagaagcagaactaacaggatacggaacggtaacaatggaatgctccccacgaacaggactcgacttcaacgaaatggtactcctacaaatggaaaataaagcctggctcgtccacagacaatggttccttgacttaccccttccctggctgcccggggccgacacccaaggctcaaactggatccaaaaagagacccttgtaaccttcaaaaacccccacgcgaagaaacaagacgtagtagtccttggctcacaggaaggagcaatgcacacagccctcacaggagcaactgaaatccaaatgtcaagcggaaacctcctcttcaccggacacctgaaatgcagactcagaatggacaaactccaactcaagggcatgtcctactcgatgtgcaccggcaagtttaaagtcgtaaaagaaatagccgaaacacaacacggcacaatagtcatacgggtccagtacgaaggcgacggctccccctgcaagatcccattcgaaataatggacctcgaaaaacgccacgtgctcgggcgcctcatcacagtgaatccaatcgtcacagaaaaagactcacccgtcaacatcgaggcagaaccgcccttcggagactcctacataataatcggcgtcgaacccggccaactcaaactcaactggttcaagaaaggttcaagcatcgggcaaatgttcgaaacgacaatgcggggcgccaaaagaatggcaatactaggcgacaccgcctgggacttcgggagcctgggcggggtgttcacctccatcggcaaagcgctccaccaagtcttcggagcaatctacggcgccgcattctcaggcgtctcatggaccatgaaaatcctaataggcgtcatcataacctggatcggaatgaacagcagaagcacatccctctcagtaacacttgtccttgtaggaatcgtcaccctatacttaggagtcatggtccaagcctaa

SEQ ID NO: 2381 - RNA, 2031 nt, synthetic construct
  misc_feature 1..2031: note = derived and/or modified CDS sequence (opt11) from DENV-2 CYD2-T__SSc-prMEdelstem_TM-JEV
  source 1..2031: mol_type = other RNA
atgtccgcaggcatgataatcatgctcatccccaccgtcatggcattccacctaacaacccgcaacggcgaaccccacatgatagttagccgccaagaaaaaggtaaaagcctactttttaaaaccgaagacggggtcaacatgtgcacactaatggcaatggacctaggcgaactctgcgaagacactatcacctacaaatgccccctactaagacaaaacgaacccgaagatattgactgctggtgtaacagcacatccacgtgggtgacctacggcacatgcactaccatgggcgaacaccgacgcgaaaaacgcagcgtagccctcgtaccccacgtaggcatgggactagaaacccggacagaaacctggatgagcagcgaaggggcatggaagcacgtacaacggatagaaacatggatcctcagacacccaggcttcaccatgatggcagcaatactcgcctacaccatcggaaccacgcacttccaacgagccctaatcttcatcctattaacagcagtaacaccctcaatgacgatgcgatgcatcggaatgtcgaaccgggacttcgtcgaaggcgtgtcagggggctcatgggtagacatagtcctcgaacacggctcatgcgtgacaacaatggccaaaaacaaacccacattagactttgaactaatcaagacagaggcaaaacaaccagcaacactcagaaaatactgcatagaagcgaaacttacaaacaccacaacagaatcaaggtgccccacccaaggcgagcccagcctcaacgaagaacaagataaacggttcgtgtgcaaacactcaatggtagaccgaggatggggcaacggatgcggactattcgggaaaggaggcatagtgacctgcgccatgttccgatgcaagaaaaacatggaaggaaaagtagtccaaccagagaacctggaatacacaatcgtaatcacaccacacagcggagaagaacacgccgtaggaaacgacacgggcaagcacggaaaggaaatcaagataacaccccaatcaagcataacagaggcggaattaaccggctacggaacagtcacaatggaatgcagcccaagaaccggcctggacttcaacgaaatggtactcctccaaatggaaaacaaagcctggctcgtacacagacaatggttcctcgacctgccgctcccatggctacctggagcagacacccaaggttccaactggatccagaaagaaaccctagtcaccttcaaaaacccacacgcaaagaagcaagacgttgtagtcctcggctcgcaagagggcgccatgcatacagccctcaccggagccacagaaatccaaatgagcagcggaaacttactgttcacaggacacctaaaatgccgactcagaatggacaaactacagctcaagggcatgtcctatagcatgtgcacaggaaaattcaaagtcgtaaaagaaatagcagaaacgcaacacggcaccatcgtcattcgcgtccaatacgaaggcgacggttcaccatgcaaaatacccttcgaaatcatggacctagagaaaagacacgtcctcggacggctcatcaccgtcaaccccatcgtcaccgaaaaagactctcctgtaaacatcgaagcggaacccccattcggcgacagctacatcattatcggcgtcgaacccggccaactcaaactcaactggttcaagaaaggaagcacacttgggaaagcattcagcacaacactcaaaggcgcacaaagactcgcagcactcggggacacggcatgggacttcggcagcatcgggggcgtcttcaactccataggccgagcagttcaccaagtcttcgggggagcattcaggacactcttcggcggaatgagctggatcacgcagggactcatgggcgccctcctactctggatgggagtcaacgccagagacagatccatagccctagcattcctagcgaccggaggcgtgctagtattccttgcaacgaacgtccacgcatga

SEQ ID NO: 2382 - RNA, 1332 nt, synthetic construct
  misc_feature 1..1332: note = derived and/or modified CDS sequence (opt11) from DENV-2 CYD2-T__SSm-EdelTM
  source 1..1332: mol_type = other RNA
atgttccaacgcgccctaatattcatcctcctaacagccgtaaccccatcaatgacaatgcgctgcataggcatgagcaaccgcgacttcgtagaaggagtctccggcggaagctgggtagacatcgtactcgaacacggcagctgcgtcaccaccatggcgaaaaacaaacccaccctagacttcgagctgatcaaaacggaagcaaaacaacccgcaaccctccgaaaatactgcatcgaggctaaactcacaaacacaacaacggaaagtcgctgcccaacgcaaggagaacccagcctaaacgaggaacaggacaaacgcttcgtttgcaaacacagcatggtagaccgcgggtggggaaacggctgcggactctttggaaaaggcggcatcgttacctgcgcaatgttcaggtgcaagaaaaacatggaaggcaaagtcgtgcaaccggaaaacctcgaatacactatagtaatcacaccccacagcggcgaagaacacgcagtcggaaacgacaccggcaaacacggcaaagagataaaaatcaccccgcaatcatccatcacagaagcagaactcaccggctacggaacagtcacaatggaatgctcgccacgaacgggactagactttaacgaaatggtactactccaaatggaaaacaaagcctggctagtacacagacaatggttcctcgacctacccctaccctggctaccaggcgcggacacacaaggcagcaactggatccaaaaggagaccctcgtaacattcaaaaacccacacgccaagaaacaagacgtcgtcgtcctaggcagccaagaaggcgccatgcacacagccctaaccggcgccacagaaatacaaatgagcagcggaaacctgctgttcacaggacacctaaaatgccgcctaaggatggacaaactacaactgaaaggcatgagctactccatgtgcacaggaaaattcaaagtcgtcaaagaaatcgccgaaacccaacacggcacaatcgtaataagagtccaatacgaaggagacggatccccctgcaaaatcccattcgaaataatggacctagagaaaagacacgtcctcggaaggctcataacggtaaaccccatcgtgaccgaaaaagacagcccagtcaacatcgaagcagaaccacccttcggggacagctacatcatcatcggcgtagaacccggccaactaaaactaaattggttcaagaaaggaagctcaataggccaaatgttcgaaaccacgatgcgcggcgcaaaacgcatggccatcctcggagacacggcctgggacttcggcagctaa

SEQ ID NO: 2383 - RNA, 2379 nt, synthetic construct
  misc_feature 1..2379: note = derived and/or modified CDS sequence (opt11) from DENV-2 CYD2-T__C-P2A-SSc-prME
  source 1..2379: mol_type = other RNA
atgaacaaccaacgcaagaaggcgaaaaacacgccattcaacatgctgaaaagagagcgaaaccgcgtcagcaccgtacaacaactaacaaagcgcttctcgctcggcatgctacagggtcgaggacccctcaaactcttcatggcactcgtagccttcctccgtttcctaaccatacccccaaccgccggtatccttaaacgctggggcaccatcaagaaatcaaaagcgatcaacgtcctacgcggattcaggaaagaaatcggccgaatgctcaacattctcaaccggcgcagaagaaacttcgacctactcaaactggccggggacgtagagagcaacccaggcccctccgcaggaatgataataatgctcatccccacagtaatggcgttccacctaacgacccggaatggcgaaccccacatgatcgtgtcgcggcaagagaagggaaagtccctcctcttcaagaccgaagacggagtaaacatgtgcaccctaatggcaatggacttaggcgaactctgcgaagacaccatcacctacaaatgccccctcctaaggcaaaacgagccggaagacatagactgctggtgcaacagcacaagcacgtgggtcacatacggaacgtgcactacaatgggcgagcaccgccgcgaaaaacgaagtgtcgcactcgtgccacacgtcgggatgggcctagaaacacgtacggaaacatggatgtcatcagagggcgcatggaagcacgtacaacgcatcgaaacctggatacttcgccaccccggatttaccatgatggctgcgatactagcatatactatagggacaacacacttccagcgggcactaatcttcatcctactaacagccgtcacacccagcatgaccatgcgctgcatcggaatgtcaaaccgagacttcgtagaaggagtcagcggtggcagctgggtagacatagtgctcgagcacggatcatgcgtcaccacaatggccaaaaacaaaccaacactcgacttcgaactaataaagacagaagcaaaacaacccgccaccctgagaaagtactgcatcgaagccaaactgaccaacacgacaaccgaatccaggtgcccaacacagggagaaccgtcactcaacgaagaacaagacaaaagatttgtatgcaaacattcaatggtcgaccgcggctggggaaacggatgcggcctcttcggaaaaggaggaatcgtcacgtgcgcaatgttcagatgcaaaaagaacatggagggcaaagtcgtacaaccagagaacctagagtacacgatcgtcataaccccacacagcggagaagaacatgctgtgggtaacgacaccggaaaacacggaaaagaaatcaaaatcaccccgcaaagcagcatcacggaagccgaactcacaggatacggtactgtcaccatggagtgcagcccaagaaccggactcgacttcaacgaaatggtcttgctgcaaatggaaaacaaggcatggctggtccacagacaatggttcctagacctacccctcccctggctcccaggagccgacacccaaggctccaactggatccagaaagaaaccttagtcaccttcaagaacccccacgcaaagaaacaagacgtcgtagtcctaggcagtcaagagggagcaatgcacaccgcactaaccggagctacggaaatccagatgagcagcggaaacctactcttcacagggcacctcaaatgccgcctacgcatggacaaactccaactaaaaggaatgagctacagcatgtgcaccggaaaattcaaggttgtaaaagaaatagccgagacccaacacggaacaatcgtcatacgcgtacaatacgagggagacgggtcgccctgcaaaataccgttcgaaataatggacctagaaaagcgacacgtcctaggaagactcatcacggtcaacccaatagtcacagaaaaagacagtcccgtaaatatcgaagcagaaccacccttcggagacagctacatcatcatcggagtggaacccggacaactaaaactaaactggttcaaaaagggatcgagcatcgggcaaatgttcgaaaccacaatgagaggcgcgaagcggatggccatcctcggggacaccgcatgggacttcggaagcctcggtggtgtgttcacatccatcggaaaagcactacaccaagtcttcggagcaatatacggcgcagccttcagtggcgtatcctggacaatgaagatcctgatcggagtcatcataacctggatagggatgaactcccgaagcacctccctaagcgtcacactggtactcgtcggcatcgtaacgctgtacctaggcgtaatggtgcaagcctaa

SEQ ID NO: 2384 - RNA, 2043 nt, synthetic construct
  misc_feature 1..2043: note = derived and/or modified CDS sequence (opt11) from DENV-2 CYD2-T__SSopt-prME(F108S)
  source 1..2043: mol_type = other RNA
atgaaacgcaagaaatcagcaggcatgatcatcatgctgatacccaccgtcatggccttccacctaactaccagaaacggcgaaccgcacatgattgtaagccggcaagaaaaaggcaaaagccttctgttcaaaaccgaggacggggtcaacatgtgcacactcatggcaatggacctaggcgaactgtgcgaagacaccatcacgtacaaatgccccctactaagacagaacgaaccagaagacatagactgctggtgcaacagcacaagcacctgggtaacctacggaacctgcaccaccatgggcgagcaccgccgagagaaaagatcggtcgccctcgtcccccacgttggcatgggactcgagacccgcaccgaaacatggatgagtagcgaaggcgcctggaaacacgtacaaagaatcgaaacctggatcctaagacaccccggattcaccatgatggccgcaatcctagcatacacaataggcaccacccacttccaacgagccctgatattcatcctcctcacagcagtaaccccgtcaatgacgatgcgctgcatcggcatgtccaaccgcgacttcgtcgagggagtcagcggcggatcctgggtcgacatagtcctcgagcacggcagctgcgtaaccacaatggccaaaaacaaaccgacactagacttcgaactaatcaaaaccgaagcaaaacaaccagcaaccctacgaaaatactgcatagaggccaaactcacaaacaccacaacagaatccagatgcccgacacaaggagagccgagcctcaacgaagaacaagacaaacgattcgtctgcaaacacagtatggtcgatcgaggatggggaaacggctgcggactgagcggcaagggaggcatagtgacatgtgcaatgttccgatgcaagaagaacatggaaggaaaagtcgtacaacctgagaacctagaatatacaatagtcatcacgccccacagcggagaggagcacgcggtgggcaacgacacaggcaaacacggaaaagaaatcaagataacaccacaatccagcatcaccgaagcagaactcaccggatacggcacagtaacaatggagtgcagcccgcggacaggactggatttcaatgaaatggtactactccagatggagaacaaagcatggctcgtacaccgccaatggttcctagacctacccctaccctggctcccaggagccgatacgcaaggctccaactggatccaaaaggaaactctagtaacatttaaaaacccccatgccaagaaacaggacgtggtagtcctaggaagccaagaaggcgccatgcacacagccctaacaggcgccaccgaaatacaaatgagcagcggcaacctgctattcaccgggcacctcaaatgccgcctacgcatggacaaactccaactcaaagggatgtcgtacagcatgtgcacagggaaatttaaagtcgtgaaagaaatcgccgaaacgcaacacgggacaatcgtcatacgagtacagtacgagggcgacggttcaccctgcaaaatccccttcgagattatggacctggagaaaagacacgtactcggaagactcatcacagtcaacccaatcgtaaccgagaaagacagcccagtcaacatagaagcagaacccccgttcggagacagctacataataatcggagtcgaaccaggacaactaaaattaaactggttcaagaaaggaagttcaatcgggcaaatgttcgagacgaccatgagaggcgccaaacgaatggcaatcctgggcgacacagcatgggacttcggctccctaggtggagtcttcacgagcatcggaaaagcattacaccaagtcttcggagcaatctatggcgccgcattcagcggcgtaagttggaccatgaaaatactaattggcgtcatcatcacctggatcggcatgaactcccgcagcacctcgctcagcgtcacgctagttctcgtcggaatagtgacactctacttaggcgtcatggtccaagcatga

SEQ ID NO: 2385 - RNA, 2043 nt, synthetic construct
  misc_feature 1..2043: note = derived and/or modified CDS sequence (opt11) from DENV-2 CYD2-T__SSopt-prME(M96H)
  source 1..2043: mol_type = other RNA
atgaaacgcaagaaatccgcagggatgatcatcatgctaatacccaccgtaatggccttccacctaactacacgaaacggcgaaccccacatgatcgtaagccgccaagagaagggaaaaagcctcctcttcaaaaccgaggacggcgtcaacatgtgcacactcatggccatggacttaggagaactctgcgaagacaccatcacctacaaatgccccctcctcagacaaaacgaacccgaagacatagactgctggtgcaactcaacaagcacatgggtaacatacggaacctgcaccaccatgggcgagcaccgccgcgaaaaacgctccgtagccctagtcccacacgtgggcatgggcctagaaacacgcacagaaacctggatgtcctcggagggagcctggaaacacgtacaaagaatagaaacctggatactcaggcacccaggcttcaccatgatggctgcaatactcgcgtacacaatcggaacaacgcactttcagcgggccctgatcttcatattactaacagccgtcacccccagcatgaccatgcgctgcatcggcatgagcaacagagactttgtagaaggagtcagcggcggtagctgggtagacatagtcctcgaacacggatcatgcgtgaccacaatggcgaaaaacaaaccaacactagacttcgaactcatcaagacagaggccaaacaacccgccacactccgcaaatactgcatcgaagcgaagctgaccaacaccacgacagaaagcagatgccctacacaaggagaaccatcactaaacgaagaacaagacaaaagattcgtatgcaaacactcacacgtagaccgcggctggggcaatggctgcggactattcggaaagggcggcatagtaacctgcgcaatgttccgatgcaagaaaaacatggaaggcaaagtagtccaacccgaaaacctcgaatacacaatcgtcatcacaccacacagtggagaggaacacgcagtcggaaacgacacaggaaaacacggcaaagagatcaaaatcaccccacaaagctcaataaccgaagcagaactgaccggatacggaaccgtaacaatggaatgcagcccccgaaccggcctagacttcaacgaaatggtactactccaaatggagaacaaagcgtggttagtacaccggcaatggttcctagacctcccgctaccgtggctaccaggtgcagacacacaaggaagcaactggatccaaaaagaaaccctcgtcacattcaaaaacccccacgcgaaaaagcaagacgtcgtagtcctcggatcccaagagggagcgatgcacacagccctcactggcgcaacagagatacaaatgtccagcggaaacctcctcttcaccggacacctcaaatgccgcctacgaatggacaaacttcaactcaagggcatgagctacagcatgtgcacgggcaagttcaaagtagtaaaagaaatcgcggaaacacaacacggaaccattgtcatccgagtccaatacgaaggcgacggatcaccctgcaaaataccattcgaaataatggacctggaaaagagacacgtacttggacgcctcatcaccgtcaaccccatagtaacagaaaaggactcaccagtcaacatcgaagcagaaccaccctttggcgacagctacataataatcggagtagaacctgggcaactcaagctgaactggttcaagaaaggatcaagcatcggccaaatgttcgaaacaaccatgagaggcgcgaaacgaatggcaatcctcggcgacacagcatgggacttcggatccctcgggggtgtattcacatccatcggcaaagcactacaccaagtcttcggggccatatacggagccgcattcagcggcgtcagctggaccatgaagatactgataggagtaataataacctggatcgggatgaacagtaggagcacgtcactaagcgtgactctagtcctagtcggaattgtcactctctacctaggcgtaatggtccaggcctaa

SEQ ID NO: 2386 - RNA, 2043 nt, synthetic construct
  misc_feature 1..2043: note = derived and/or modified CDS sequence (opt11) from DENV-2 CYD2-T__SSopt-prME(S186F)
  source 1..2043: mol_type = other RNA
atgaagcgcaaaaagtccgccggaatgataataatgctcatccccaccgtcatggcctttcacctgacaacccgaaacggcgaaccacacatgatagtgagccggcaagaaaaaggcaaaagcctgctgttcaaaacagaagacggagtcaacatgtgcaccctaatggccatggacctaggagaactctgcgaagacacaataacctacaaatgccccttactccgacaaaacgaaccagaagacatagattgctggtgcaacagcaccagcacctgggtcacctacggaacatgcacaaccatgggagaacacagacgagagaaaagatcagtagcactggtaccgcacgttggaatgggactagaaacacgaacagaaacatggatgtcaagcgaaggcgcctggaagcacgtccaacggatcgaaacatggatactaaggcacccgggcttcacaatgatggccgcaatactagcatatacaataggcacaacgcacttccagagggccctaatatttatattactgaccgcagtaacaccaagcatgacaatgagatgcatcggaatgtccaacagggacttcgtagaaggcgtgagtgggggctcatgggtagacatcgtcttagaacacgggagctgcgtaaccacgatggccaaaaataaaccaaccctagacttcgaactgataaaaactgaagccaagcaaccagccacgctccggaaatactgcatagaagccaaactaaccaacaccacgaccgaaagccgctgcccaacccaaggcgaaccctcgctgaacgaagaacaggacaaaagattcgtctgcaagcatagcatggtagacagaggatggggcaacggctgcggcctgttcggaaagggaggcatagtcacatgcgcaatgttccgatgcaaaaagaacatggaaggaaaggtagtccaaccggaaaacttagaatacacaatagtcataacgccacactcgggcgaagaacacgcagtagggaacgacacaggaaaacacggcaaagaaatcaagataacccctcagagcagcatcacagaagcagaattaaccgggtatggcacagtaaccatggaatgcttcccccgcacgggactagacttcaacgaaatggtactcctgcaaatggaaaacaaagcatggctagtccatcgccaatggttccttgacctacccctgccgtggctacccggagccgacacacagggctcaaactggatacaaaaagagaccctcgtgacattcaagaacccccacgccaagaaacaagacgtcgtcgtactcggatcccaggaaggcgcaatgcacactgcactaaccggcgcaaccgaaatccaaatgagcagcggcaacctactattcaccggccatctcaaatgccgcctccgaatggacaaactccaactaaaaggaatgagctacagcatgtgcaccggcaaattcaaagtcgtaaaagaaatcgcggagacacaacacggcacaatcgtaatccgcgtacaatacgaaggagacggaagcccctgcaaaatacccttcgaaatcatggacctcgagaaaaggcacgtactcgggcgactgatcaccgtcaacccaatagtcaccgaaaaggacagcccagtgaacatcgaagcggagccaccctttggcgacagctacatcataatcggggtggaaccaggacaattgaaactgaactggttcaagaaaggcagctcgatcgggcagatgttcgagacaacgatgcgaggcgcaaaacgaatggccatcttgggagacacagcgtgggacttcgggagcctgggcggggtattcacctccatcggcaaagcactccaccaggtattcggggccatctacggtgccgcattctcaggcgtaagctggaccatgaagatcctcatcggcgtcataataacctggataggcatgaacagtagaagcacgagcctgagcgtgaccctagtcctcgtaggcatagtgaccctctacctaggcgtgatggtgcaagcatga

SEQ ID NO: 2387 - RNA, 2043 nt, synthetic construct
  misc_feature 1..2043: note = derived and/or modified CDS sequence (opt11) from DENV-2 CYD2-T__SSopt-prME(R188L)
  source 1..2043: mol_type = other RNA
atgaaacgaaagaaaagcgcaggaatgataatcatgctcatccctacagtaatggccttccacctcacaacaagaaacggagaaccgcacatgatagtcagcagacaagagaaaggcaaaagtctcctattcaagaccgaagacggcgtaaacatgtgcacactaatggctatggacctcggagaactatgcgaagacacgatcacctacaaatgccccctactgcgacagaacgaacccgaagacatagactgctggtgcaactccacaagcacatgggtcacgtacggaacatgcaccacgatgggagaacacaggagagaaaaacgctcagtagcactcgtcccccacgtgggaatgggactcgaaaccaggaccgagacctggatgagcagcgaaggagcatggaaacacgtacaaaggatcgaaacctggatcctccggcacccaggattcacgatgatggcagcaatactagcatacacaataggcaccacccacttccagcgagcgctaatcttcatactactcacggcggtcacacccagcatgacaatgcgatgcataggcatgagcaaccgcgacttcgtggagggcgtatccggaggaagctgggtagacatagtcctagaacacggaagctgcgtaacgaccatggcgaaaaacaaacccaccctcgacttcgaactaatcaaaacggaggccaaacaacccgcaacactacgcaaatactgcatagaagcgaagctaacaaacaccacaacagaatcacgatgccccacccaaggcgaaccaagtcttaacgaagaacaggacaagcgatttgtatgcaaacacagcatggtcgaccgaggctggggaaacggctgcggcctgttcggaaagggcggcatcgtgacgtgcgcaatgttcaggtgcaagaaaaacatggaaggaaaagtcgtgcagcccgaaaacctggaatacacgatagtcatcacccctcacagcggcgaggaacacgcggtcggaaacgacaccggaaaacatgggaaagagatcaaaatcacaccccaatccagcattaccgaagccgagctaaccggctacggaacggtaaccatggagtgcagcccgctaaccggactcgacttcaatgaaatggtcctactacaaatggaaaacaaggcatggctcgtccaccgacaatggttcctcgacctccccctcccatggctacccggcgccgacacccagggctccaactggatacaaaaagagacgctcgtcacattcaaaaaccctcacgcgaagaagcaagatgtggtcgtactaggaagccaggaaggcgcaatgcacacagccttaacaggcgccaccgaaatccaaatgtccagcggcaaccttctcttcacggggcacctgaaatgcagactgagaatggacaaactgcaactcaaaggaatgagctactcaatgtgcacaggcaaattcaaagtcgtaaaggaaatcgccgagacccaacacgggaccatagtcataagagtacaatacgaaggggacggcagcccgtgcaaaatccctttcgaaattatggaccttgaaaaacgccacgtcctaggccgactaataaccgtaaaccccatagtgacagagaaagattcccccgtaaacattgaagcagaaccaccgttcggagacagctacataataataggcgtcgaaccgggccaactcaaactaaactggttcaagaaaggcagcagcatcggacagatgttcgaaacgaccatgcgcggagcaaaacgcatggcaatactaggcgacacagcctgggatttcggaagcctaggaggggtattcacatcaatcggcaaggcactccaccaagtcttcggcgcaatttacggcgccgcattcagcggagtatcgtggacgatgaaaatcctaatcggagtcataataacctggataggcatgaactcgcgcagtacaagcctctcggtcaccctagtgctggtcggaatagtaaccctatacctcggagtcatggtgcaagcataa

SEQ ID NO: 2388 - RNA, 2043 nt, synthetic construct
  misc_feature 1..2043: note = derived and/or modified CDS sequence (opt11) from DENV-2 CYD2-T__SSopt-pr(D104A)MEdelstem_TM,(F108S)-JEV
  source 1..2043: mol_type = other RNA
atgaaacgaaagaaatccgccggaatgataatcatgctgatcccaacagtaatggcattccacctcactacccggaacggcgaaccacacatgatcgtctctcgccaagaaaaaggcaaaagcctcttattcaaaaccgaggacggcgtcaacatgtgcacactcatggcaatggacctaggcgagctgtgcgaagacaccatcacatacaaatgccccctccttcgccaaaacgagcccgaagacatagactgctggtgcaacagtacttcaacctgggtaacatacgggacctgcacaactatgggcgagcaccgccgcgccaaacgatcagtcgccctggtacctcacgtcggaatgggcctagaaacacgcacagaaacctggatgtcatccgaaggcgcctggaaacacgtacaacgaatcgaaacatggatcctcagacacccaggcttcaccatgatggccgcaatactagcctacaccatcggcaccacacacttccaaagagccctcatatttatactactcaccgcggtgacaccatctatgaccatgagatgcataggcatgtccaaccgcgacttcgtagaaggcgtaagcggcggctcgtgggtagacatcgtcctagaacacgggagctgcgtcaccacaatggcgaaaaacaaaccaaccctcgacttcgagctaatcaaaacggaagcgaagcaaccagccacgctccggaaatactgcatcgaagcgaaactcacaaacacaacgaccgaaagccgatgtcccacccaaggagaaccaagcctcaacgaagaacaagacaaacgcttcgtttgcaaacacagtatggtagacagaggctggggaaacggctgcggcctgagtggtaagggcggcatagtaacctgcgccatgttccggtgcaagaaaaacatggaaggcaaagtcgtccaacccgaaaacctagagtacacaatagtcatcacgccccatagcggcgaagaacacgccgtaggaaacgacaccggaaaacacggaaaagaaatcaaaatcaccccgcaaagctccataaccgaagcggaactcacaggatacggcacggtcacaatggaatgcagcccccgcacaggcctcgacttcaacgaaatggtgctactacaaatggaaaacaaagcatggctagtgcaccgtcaatggtttctggacctccccctaccctggctcccaggagccgacacccaaggctcgaactggatacaaaaagaaaccctcgtcaccttcaaaaacccacacgccaagaaacaagacgtggtcgtcctagggagccaggaaggagccatgcacaccgcactcaccggcgccaccgaaatccagatgtcaagcggcaatctcctcttcacaggccacctcaaatgccgcctaagaatggacaaactccaactaaaaggaatgagctactcaatgtgcaccggcaagttcaaggtagtaaaggaaatcgcagaaacccaacacgggacgatcgtaatcagagtacaatacgaaggcgacggcagcccttgcaaaatcccattcgagataatggacctcgaaaaacgccacgtcctaggccgcctaataaccgtcaaccctatcgtaacagaaaaggacagccccgttaacatagaagcagaaccgccattcggtgacagctacataatcataggcgtcgaaccaggacaactaaaactaaactggttcaagaaaggaagcacactaggaaaagcgttctccacaacgttaaaaggagcacaaagactagccgccctcggcgacaccgcatgggacttcggatccataggcggagtattcaacagcattggccgagcagtacaccaggtgttcggcggcgccttcagaaccctcttcggtggaatgtcctggataacgcagggactcatgggagcactcctcctctggatgggagtaaacgcacgagaccggtcaatagcactggccttcctcgccaccgggggcgtcctggtcttcctagcaacaaacgtccacgcctag

SEQ ID NO: 2389 - RNA, 2043 nt, synthetic construct
  misc_feature 1..2043: note = derived and/or modified CDS sequence (opt11) from DENV-2 CYD2-T__SSopt-prMEdelstem_TM,(H261N)-JEV
  source 1..2043: mol_type = other RNA
atgaaacgaaagaaaagcgccggaatgataatcatgctgatacccaccgtcatggcattccatctaacaacacgcaacggcgaaccacacatgatcgtcagccgccaggaaaaaggcaaaagcctactcttcaaaaccgaagacggcgtcaacatgtgcacacttatggccatggacctgggcgaactatgcgaagacacaatcacctacaaatgccccctactgagacaaaacgaaccagaagacatcgactgctggtgcaacagcacgagcacgtgggtcacctacggaacgtgcaccaccatgggcgagcaccgccgagaaaaacgaagcgtcgccctggtaccccacgtcggaatgggcctagaaacccgaacagaaacatggatgagctccgaaggagcctggaaacacgtacaacgcatcgaaacgtggatcctgagacaccctggcttcaccatgatggcagcaatattagcttacacaatcggaaccacacacttccaacgcgcactaatattcatactactaacagccgtcacgcccagcatgacaatgagatgcataggaatgtcaaaccgagactttgtagaaggggtaagcgggggaagctgggtcgacatcgtactggaacacggctcgtgcgtcaccacgatggccaaaaacaaaccaaccctagacttcgaactgatcaaaacagaagcaaaacaaccagcaaccctaagaaagtactgcatcgaagcgaagctaacaaataccacaaccgaatccagatgcccaacacaaggcgagcccagcctcaacgaggaacaggacaaacgattcgtctgcaaacactcgatggtcgaccgcggatggggcaacggctgcggcctgtttggaaaaggcggaatagtgacctgcgcgatgttcagatgtaagaaaaacatggaaggtaaagtcgtacaaccggaaaacctcgaatacaccatcgtgataacaccccactccggcgaagaacacgccgtgggcaacgacaccggaaagcacggaaaagaaatcaaaataacccctcaaagcagcataaccgaagcagaactcaccggatacggaaccgtcacaatggaatgcagcccgcgcacgggcctcgacttcaacgaaatggtcctcctgcaaatggagaacaaagcatggctcgtccaccgccagtggttcctcgacctccccctcccatggctaccaggcgcagacacgcaggggagcaattggatacaaaaagaaacgctggtcacattcaaaaacccccacgccaagaaacaggacgtcgtcgtcctcggatcacaagaaggcgcaatgaacaccgcactcaccggagcgaccgaaatccaaatgtcctcagggaacctactctttacaggccatttaaaatgtaggctccgcatggacaaactacagctcaaaggcatgtcctactcaatgtgcacagggaaattcaaagtggtaaaagaaatcgccgaaacacaacacggaacaattgtgatcagagtacaatacgagggcgacggctcaccctgcaaaatacccttcgaaataatggacctagaaaaacgacacgtcctggggcgcctgataaccgtcaacccgatcgtaacagaaaaagactctcccgtcaacatcgaagcggagccgcccttcggagatagctacatcatcatcggggtggaacccggacaactgaaactaaactggttcaagaaaggaagcaccctcggaaaagcattcagcaccaccctgaaaggcgcacaacgactcgcggccctgggcgatacagcctgggacttcggatccatcggaggcgtattcaacagcatcggcagagcagtccaccaagttttcggaggggcgttccgaacactattcggcggcatgagctggataacccaagggctaatgggcgcactcctgctatggatgggcgtaaacgcacgcgaccggagcatagcactcgccttcctcgcaaccggcggcgtcctcgtcttcctggccacaaacgtgcacgcctga

SEQ ID NO: 2390 - RNA, 2043 nt, synthetic construct
  misc_feature 1..2043: note = derived and/or modified CDS sequence (opt11) from DENV-2 CYD2-T__SSopt-prMEdelstem_TM,(R188L,A267T)-JEV
  source 1..2043: mol_type = other RNA
atgaagcgcaaaaagtctgcaggcatgataataatgctaatacccaccgtcatggcctttcacctaacaacgcgaaacggcgaaccgcacatgatagtctcacgccaagaaaaaggcaagagcctactctttaaaacggaagacggcgtcaacatgtgcaccctaatggccatggacctcggagaactgtgcgaagacacaatcacctacaaatgccccctactccgccaaaacgaacccgaagacatcgactgctggtgcaacagcacgtcaacatgggtgacatacgggacctgcaccaccatgggcgaacacagacgagaaaaacgaagcgtagctctcgtcccccacgtaggcatgggcctagaaacccgcacagaaacatggatgtcatccgaaggcgcctggaaacacgttcaacgcatagaaacatggatactccgacacccaggcttcaccatgatggcagcaatcctagcatatacaatcggcaccacccactttcaacgcgcactcatattcatcctactaacagccgtaaccccctcaatgacaatgcgctgcataggcatgtccaaccgagacttcgtcgaaggagtcagcggaggatcatgggtcgacatcgtcctagaacacggctcatgcgtaacaacaatggccaaaaacaagccaacgctggacttcgaactgatcaaaacagaggccaaacaaccagcaacgctgcgaaagtactgcatagaagcaaaactcaccaacaccacaactgaaagccgctgcccaacacaaggcgagccaagcctcaacgaagaacaagacaaaagattcgtctgcaaacacagcatggtcgacaggggttggggaaacggctgcggcctattcggaaaaggcggcatagtaacatgcgcaatgttcagatgcaagaaaaacatggaggggaaagtcgtacagcccgaaaacctggaatacaccatcgtcataacaccacactcaggcgaagaacacgccgtcggcaacgacacaggcaagcacggaaaagaaataaagataaccccacaaagcagcatcacagaagcagaactcaccggctacgggaccgtcaccatggaatgttcgccgctcacaggccttgacttcaacgaaatggtgttactacagatggaaaacaaagcatggctcgtccaccgacaatggttcctcgacctacccctcccctggcttccaggcgccgacacccagggcagcaactggatccaaaaggaaaccttagtcaccttcaaaaacccgcacgcaaagaaacaagacgtcgtggtacttggcagccaggaaggagcgatgcacaccgcactcaccggcacaacggaaatacaaatgagctccgggaacctactcttcacagggcacctcaaatgccggctccggatggacaaactacaactaaagggaatgtcctactctatgtgcaccggcaagttcaaagtcgtaaaagaaatcgccgaaacccaacacggcacgattgtgatcagagtacaatacgaaggagatggcagcccctgcaaaatccccttcgaaataatggacctagagaaaagacacgtactcggcagactgataaccgtcaaccccatagtaacagaaaaagatagcccagtcaacatcgaagcagaaccaccattcggcgacagctacatcataatcggagtcgaaccaggacagctaaaactcaactggtttaaaaagggaagcacacttggcaaagcattctcaacaacgctcaaaggcgcacaacggctcgccgccctaggcgacaccgcgtgggacttcggcagtatcggcggagtattcaactcaatcggacgcgcagtccaccaggtcttcggaggcgccttccgaacactattcggaggcatgagctggatcacgcaaggcctaatgggagcgctgctattatggatgggggtaaacgcccgcgaccggagtatagccctggcattcctcgccactgggggcgtgctcgtcttcctagcaacaaacgtacacgcgtaa

SEQ ID NO: 2391 - RNA, 297 nt, synthetic construct
  misc_feature 1..297: note = derived and/or modified CDS sequence (opt11) from DENV-4 Consensus__C
  source 1..297: mol_type = other RNA
atgaaccaacgcaaaaaagtcgtccgcccccccttcaacatgctcaaacgcgaacgcaaccgcgtctccaccccccaaggcctagtcaaacgcttctccaccggcctcttctccggcaaaggccccctccgcatggtcctcgccttcatcaccttcctccgcgtcctctccatccccccaaccgccggcatcctcaaacgctggggccaactcaaaaaaaacaaagccatcaaaatcctcatcggcttccgcaaagaaatcggacgcatgctcaacatcctcaacggccgcaaacgc

SEQ ID NO: 2392 - RNA, 339 nt, synthetic construct
  misc_feature 1..339: note = derived and/or modified CDS sequence (opt11) from DENV-4 Consensus__C-SSc
  source 1..339: mol_type = other RNA
atgaaccaacgcaaaaaagtcgtccgcccccccttcaacatgctcaaacgcgaacgcaaccgcgtctccaccccccaaggcctcgtcaaacgcttcagcaccggcctcttctccggcaaaggccccctccgcatggtcctcgccttcatcaccttcctccgcgtcctctccatcccccccaccgccggcatcctcaaacgctggggccaactcaaaaaaaacaaagccatcaaaatcctcatcggcttccgcaaagaaatcggccgaatgctcaacatcctcaacggacgcaaacgctccaccatcaccctcctctgcctcatccccaccgtcatggcc

SEQ ID NO: 2393 - RNA, 273 nt, synthetic construct
  misc_feature 1..273: note = derived and/or modified CDS sequence (opt11) from DENV-4 Consensus__pr
  source 1..273: mol_type = other RNA
tttcacttgagcacgcgcgatggcgagcccttgatgatagtcgcgaaacatgaaagaggcaggcccttgctctttaaaacgaccgagggcataaacaagtgcacgctcatagccatggacttgggcgagatgtgtgaagataccgtgacctataaatgtcccttgctcgtgaacacggaaccggaagatatcgactgctggtgcaatctcacgagcacgtgggtgatgtatggcacgtgcacgcaatcgggcgagcgcaggcgcgagaaaagg

SEQ ID NO: 2394 - RNA, 225 nt, synthetic construct
  misc_feature 1..225: note = derived and/or modified CDS sequence (opt11) from DENV-4 Consensus__M
  source 1..225: mol_type = other RNA
agcgtggccttgaccccgcactcgggcatgggcttggaaacgcgcgcggaaacgtggatgagctcggaaggggcctggaaacatgcccagcgcgtggaatcgtggatactcaggaacccgggctttgccttgctcgcgggctttatggcgtacatgatcgggcaaacgggcatacaaaggaccgtgttctttgtcctgatgatgctcgtggccccgagctatggc

SEQ ID NO: 2395 - RNA, 498 nt, synthetic construct
  misc_feature 1..498: note = derived and/or modified CDS sequence (opt11) from DENV-4 Consensus__prM
  source 1..498: mol_type = other RNA
ttccacctatccacacgcgacggcgaacccctcatgatcgtcgccaaacacgaacgcggccgccccctcctcttcaaaaccaccgaaggcataaacaaatgcaccctcatcgccatggacctcggcgaaatgtgcgaagacaccgtcacctacaaatgccccctcctcgtcaacaccgaacccgaagacatcgactgctggtgcaacctcacctccacctgggtcatgtacggcacctgcacccaatcaggcgaacgccgccgcgaaaaacgctccgtcgccctcaccccccactccggcatgggcctagaaacccgcgcagaaacctggatgtcctccgaaggcgcctggaaacacgcccaacgcgtcgaatcatggatactccgaaaccccggcttcgccctcctagccggcttcatggcctacatgatcggccaaaccggcatccaacgcaccgtattcttcgtcctcatgatgctcgtcgccccctcctacggc

SEQ ID NO: 2396 - RNA, 1485 nt, synthetic construct
  misc_feature 1..1485: note = derived and/or modified CDS sequence (opt11) from DENV-4 Consensus__E
  source 1..1485: mol_type = other RNA
atgagatgcgtgggcgtagggaacagagacttcgtcgaaggggtaagcggcggggcatgggtagacctcgtgctagagcacggaggctgcgtgacaacgatggcgcagggaaagccgacactggacttcgagctcaccaaaacgacggcaaaggaggtagcgctcctaagaacgtactgcatcgaggcgtcgatcagcaacataacaacggcaacgaggtgcccaacgcaaggagagccatacttgaaagaagaacaggaccagcagtacatatgccgaagagacgtagtagaccgaggatggggaaacgggtgcggactgttcggaaagggaggcgtagtgacctgcgccaagttcagctgcagcgggaagataacggggaacctcgtgcaaatagaaaacctagagtacacggtagtggtaacagtccacaacggggacacgcacgcggtaggcaacgacacgagcaaccacggggtaacagcaaccataaccccgcgaagtccatcggtggaagtgaagctgccagactatggagaactcacactggactgcgagcccaggagcgggatagacttcaatgaaatgatattaatgaaaatgaaaaagaagacatggctcgtacacaagcaatggttcctagacctgccactaccgtggacagcaggagcggacacgagtgaagtacactggaactacaaggaaagaatggtgacattcaaagtgccacacgcaaagagacaggacgtaacggtgctgggaagccaagagggggcaatgcacagcgcactggcgggagcaacggaagtcgacagcggagacggaaaccacatgttcgcgggacacctaaaatgcaaggtaaggatggagaaactgagaataaaagggatgagctacacaatgtgcagcgggaaattctcaatagacaaggaaatggccgagacacaacacggaacaacggtagtgaaggtaaaatacgaaggggcaggagcgccgtgcaaagtcccgatagaaataagggacgtgaacaaggaaaaagtagtcgggagggtaataagtagcacaccactcgcagaaaacaccaacagcgtaacaaacatagaactagagccaccattcggagactcatacatagtgataggagtgggcaacagcgccctaacactacactggttcaggaaaggaagcagcataggaaagatgttcgaaagcacctacagaggagcgaaacgaatggcgatactaggggaaacagcatgggacttcggaagcgtaggaggcctgttcacaagcctaggaaaggcggtgcaccaagtcttcgggagcgtatacaccacgatgttcggaggggtgagctggatgataagaatactgatagggttcctggtactatggatagggacgaacagtagaaacacgtcaatggcgatgacgtgcatagcagtaggcgggataacgctattcctaggattcacagtacaagca

SEQ ID NO: 2397 - RNA, 1983 nt, synthetic construct
  misc_feature 1..1983: note = derived and/or modified CDS sequence (opt11) from DENV-4 Consensus__prME
  source 1..1983: mol_type = other RNA
tttcacctgtccacgcgcgacggagagcccctcatgatagtcgcgaaacacgaaagaggacgaccactactcttcaaaaccacggaaggaataaacaaatgcacactaatagcgatggaccttggagaaatgtgcgaagacacggtgacatacaagtgccccctcctagtaaacacagaaccagaagatatagactgctggtgcaaccttacgagcacatgggtgatgtacggcacatgcacacaatcaggcgaaaggcgaagagaaaaacgatcggtcgcgttaaccccgcacagcggcatgggcttggaaacacgagcagaaacgtggatgtccagcgaaggagcatggaaacacgcgcaacgcgtcgaaagctggatactaaggaaccccggcttcgcactcctcgcagggttcatggcgtacatgatcgggcaaacggggatacaaagaacagtgttcttcgtactaatgatgctagtggcaccaagctacggcatgcgctgcgtcggagtcggcaacagagacttcgtcgaaggtgtgagcggaggagcatgggtagacctcgtactagagcacggaggctgcgtaacaacaatggcgcaaggaaaaccaacattggacttcgaactgaccaaaaccaccgccaaagaagtcgccctgctgagaacctactgcatcgaagcaagcatcagcaacatcacgaccgcgacgagatgtccaacgcaaggggaaccctacctcaaggaagaacaagaccaacagtacatatgcagacgagacgtggtagaccgaggatggggaaacggatgcggcctgttcgggaaaggaggcgtagtaacctgcgcgaaattcagctgtagcggaaaaataaccggaaacctagtccagatcgaaaacttagaatacacagtcgtcgtcacagtacacaacggagacacccacgccgtcggaaacgatacaagtaaccacggggtaacggcaaccataacgccgagaagcccgagcgtcgaggtgaaactccccgactacggagagctgacattagactgcgaaccacggagcggcatagacttcaacgaaatgatcctaatgaaaatgaaaaagaaaacgtggctagtgcacaaacagtggttcctcgacctaccgctaccatggacagccggggcagacacatcagaggtacactggaactacaaagaacgaatggtaacattcaaagtcccacacgcaaaaagacaagacgtgacggtactgggaagccaggagggcgcaatgcacagcgcgctggcaggcgcgacggaagtcgacagcggagacggaaatcacatgttcgcaggacatctaaagtgcaaggtccgcatggaaaaactcaggataaaagggatgagctacacgatgtgcagcggcaaattcagcatcgacaaagaaatggcagaaacacaacacggcacgaccgtggtaaaggtgaaatacgaaggcgccggcgcaccatgcaaagtgcccatagaaatccgagacgtcaacaaggaaaaagtagtcggacgcgtgatcagctcaacaccactagcggaaaacacaaacagcgtaacaaacatagaactagaaccaccattcggcgacagctacatagtaataggagtagggaacagcgccctcacactccactggttcagaaaaggaagcagcataggtaaaatgttcgaaagcacataccggggagcaaaaaggatggcgatcctcggtgagacagcgtgggacttcggaagcgtaggagggctattcacatcgctcgggaaggcagtacaccaagtattcggaagcgtatacacgacaatgttcggcggagtgagctggatgataaggattctaataggcttcctagtactgtggataggaacaaactccaggaacacgtcaatggccatgacctgcatcgcagtcggaggcatcacactattcctagggttcacagtacaagca

SEQ ID NO: 2398 - RNA, 2025 nt, synthetic construct
  misc_feature 1..2025: note = derived and/or modified CDS sequence (opt11) from DENV-4 Consensus__SSc-prME
  source 1..2025: mol_type = other RNA
agcacaataacactcctctgcctcataccgacggtcatggccttccacctaagtacacgagatggagaacccctgatgatagtagcgaagcacgaaaggggccgccccctgctgttcaagacgaccgaaggcataaacaaatgcacgttaatagccatggacctgggagaaatgtgcgaggacaccgtgacgtacaaatgcccgctcctagtaaacacggagccggaagacatagactgctggtgcaatctaacaagcacctgggtgatgtatgggacctgcacgcagagcggcgaacggaggagagaaaaacgaagcgtggcgctgaccccgcacagcggcatgggcctggaaacacgcgccgaaacatggatgagcagcgaaggagcatggaaacacgcccagcgagtagaaagctggatactcagaaacccaggctttgcccttctcgcgggattcatggcgtacatgatcggacaaacaggaatacaaagaacagtcttcttcgtactgatgatgctagtagccccaagctacggcatgcgatgcgtcggagtcgggaacagagacttcgtcgaaggcgtgagtggaggagcgtgggttgacctagtcctagaacacggcggctgcgtgactacaatggcacaaggaaaaccaacgctggacttcgaactcacaaaaaccacggccaaggaagtagccttgcttaggacatactgcatcgaagcgagcatatccaacatcacgaccgcgactagatgcccgacgcaaggcgaaccatacctaaaagaggagcaggaccaacaatacatatgccgacgagatgtagtggacagaggttggggaaacggatgcggactgttcggaaaagggggagtagtcacgtgcgcaaaattcagctgcagcgggaaaatcaccgggaacctagtacaaatcgagaacctggaatacacggtggtcgtgacagtccacaacggggacacacatgcggtcggcaatgacacgagcaaccacggagtaacagcaacaataacgccacggagcccaagcgtggaggtaaagttacccgactacggagaactaacactagactgtgaaccacgctcaggcatagacttcaacgaaatgatcctaatgaaaatgaaaaagaaaacatggctagtccacaaacaatggttcctggaccttccgctcccgtggacagcaggagccgacaccagcgaggtgcactggaactataaagagagaatggtcacgttcaaagtgccgcacgcaaaaagacaagacgtgacagtcctagggtcacaagaaggcgcgatgcacagcgcccttgcgggcgccactgaagtagacagcggcgacggaaaccatatgttcgcaggacatctgaaatgcaaagtgcggatggaaaagctacgaataaagggcatgtcgtacaccatgtgctcgggcaagttcagcatcgacaaagagatggcagaaacccaacacggaactaccgtggtgaaggtcaagtacgaaggggcaggagcgccatgcaaagtaccaatcgaaatacgagacgtcaacaaggagaaagtggtaggaagagtgatctcgagcacgcccctcgcagaaaacacgaacagtgtcaccaacatagaactggaaccaccattcggagacagctacatagtaataggagtaggaaacagcgcactcacactacactggttcaggaagggaagctcaatcgggaaaatgttcgagagcacatacagaggcgcaaaaagaatggcgatcctgggcgagacagcgtgggacttcggaagcgtcgggggactcttcaccagcctcggaaaagcggtccaccaagtgttcggcagcgtatacaccacgatgttcggaggagtaagctggatgatacgaatactaataggcttccttgtcctctggatcgggacgaatagcagaaacacatcaatggccatgacctgtatagcagtcgggggtataacactgtttctaggattcaccgtacaagcc

SEQ ID NO: 2399 - RNA, 2322 nt, synthetic construct
  misc_feature 1..2322: note = derived and/or modified CDS sequence (opt11) from DENV-4 Consensus__C-prME
  source 1..2322: mol_type = other RNA
atgaaccaaaggaaaaaggtcgtcagacccccattcaatatgctcaaacgcgaacgcaaccgcgtaagtacgccccaaggcctcgtcaaacgcttcagcacaggcctcttctcaggtaaaggcccactacgaatggtcttagcattcatcaccttcctccgagtcctgtccataccaccaacggccggcatactcaaacgctggggccagcttaagaaaaacaaagcaataaaaatcctgataggattccgcaaagagatcgggcgaatgctaaacatcctcaacggacgaaaacgctcgacgataacactcctatgcctcataccgacggttatggcattccacctgagcacacgcgacggcgaaccactcatgatcgtcgcaaaacacgaacgaggcagaccccttctattcaaaacgacagagggcatcaacaaatgcacactaatcgccatggacttaggcgaaatgtgcgaagacacagtaacatacaaatgcccactactggttaacacagaaccagaagacatagactgctggtgcaacctaaccagcacctgggtcatgtacggcacatgtacacaatccggggaacgccgccgcgaaaaacgcagcgtggcgctaacgccacacagcggcatgggactcgaaaccagggctgaaacgtggatgagtagcgaaggagcatggaaacacgcacagagagtcgaaagctggatacttcgaaacccaggcttcgccctactcgcaggcttcatggcatacatgataggacagaccggcatccaaagaacagtgttcttcgtcctgatgatgctcgtcgcccccagctacggaatgcggtgcgtcggagtcggaaatagggacttcgtcgaaggagtaagcggcggcgcctgggtcgacctagtcctagagcacggaggctgtgtcaccacaatggcacaaggcaaaccgacgctggacttcgaactaaccaaaacaacagccaaagaagtggccctactgagaacatactgcatagaagcaagcataagcaacatcacaaccgcgacccgatgcccaacccaaggcgaaccctacctaaaagaagaacaagaccagcaatacatctgcaggagagatgtggtagatagaggctgggggaacggatgcggactcttcgggaaaggaggagtggtaacatgcgccaaattctcctgctccggcaagataaccggaaacctagtacaaatcgagaacctggaatacacggtcgtcgtaaccgtccacaacggagacacccacgcggtaggaaacgacacaagcaatcacggcgtcacagccactataacacccaggagcccaagcgtggaagtaaaactaccagactacggggagctcacattagactgcgaaccacgctctggaatagacttcaacgaaatgatactcatgaagatgaaaaagaaaacatggttggtccacaaacaatggttcctagacctcccactcccgtggacggcgggcgccgacacctccgaagtccactggaactacaaagaacgcatggtaacgttcaaagtcccgcacgcaaaaagacaagacgtcacagttctcggtagtcaagagggcgcaatgcacagcgccctcgccggcgccaccgaggtagacagcggagacgggaaccacatgttcgccggacaccttaaatgcaaagtacgtatggagaaacttcgcataaaaggcatgagctacactatgtgctcaggcaaattctcaatcgacaaagaaatggccgaaacacagcacggcacaacagtcgtaaaagttaaatacgagggcgcgggcgccccctgcaaggtgccaatagaaattcgcgacgtcaacaaggagaaagttgtcggacgcgtaatatcatccacacccctcgcagaaaacaccaactcagtaacgaacatagaactcgaaccacctttcggcgacagctacatagtgataggcgtcgggaacagcgccctaacactccattggttcagaaagggaagctcaattggaaaaatgttcgagagcacatacagaggcgccaaaagaatggcaattctcggcgaaaccgcatgggacttcggcagcgtaggcggcctcttcacctcactcggaaaggcagtccaccaagtgttcgggagcgtgtacacgactatgttcggcggcgtctcatggatgatacgcatcctcatagggttcctcgttctgtggataggcaccaactcacgcaacacatcgatggccatgacctgcatcgcagtcggaggcatcaccctattcctcggattcaccgtacaagca

SEQ ID NO: 2400 - RNA, 45 nt, synthetic construct
  misc_feature 1..45: note = derived and/or modified CDS sequence (opt11) from DENV-4 Consensus__SSc
  source 1..45: mol_type = other RNA
atgtccacaatcaccctcctctgcctcatccccaccgtcatggcc

SEQ ID NO: 2401 - RNA, 57 nt, synthetic construct
  misc_feature 1..57: note = derived and/or modified CDS sequence (opt11) from DENV-4 Consensus__SSopt
  source 1..57: mol_type = other RNA
atgaaacgcaaaaaatccaccatcaccctcctctgcctcatccccaccgtcatggcc

SEQ ID NO: 2402 - RNA, 57 nt, synthetic construct
  misc_feature 1..57: note = derived and/or modified CDS sequence (opt11) from DENV-4 Consensus__SSm
  source 1..57: mol_type = other RNA
atgatccaacgcaccgtcttcttcgtcctcatgatgctcgtcgccccctcctacggc

SEQ ID NO: 2403 - RNA, 1488 nt, synthetic construct
  misc_feature 1..1488: note = derived and/or modified CDS sequence (opt11) from DENV-4 Consensus__E
  source 1..1488: mol_type = other RNA
atgcgctgcgtcggagtcggaaaccgagactttgtagaaggggtaagcggaggcgcatgggtagacctggtcctagagcacggagggtgcgtaacaaccatggcacaaggcaaaccaacactggacttcgaactaacaaaaacaacggcaaaagaagtagccctactaagaacctactgcatagaagcaagcataagcaacatcaccacagcaaccagatgcccgacacaaggcgaaccctacctaaaagaggaacaagaccaacaatacatatgcagacgagacgtcgtagacaggggctggggaaacggctgcggactattcgggaagggaggagtcgtcacatgcgcaaaattcagttgcagcggaaaaataaccggaaacctcgtccaaatagagaacctggaatacaccgtagtagtaacagtgcacaacggcgacacacacgcagtcggaaacgacacaagcaaccacggagtcacggccacgatcacaccccgaagcccaagtgtggaagtgaagttgccagactacggggaactgaccctcgactgcgaaccgcgcagcggcatagacttcaacgaaatgatactcatgaagatgaaaaagaaaacatggctagtccataaacaatggttcctggacctcccactcccgtggacagccggagcagacaccagcgaagtgcactggaactacaaagaaagaatggtcacgttcaaagtcccacacgccaaaagacaagacgtcaccgtactaggctcacaagaaggcgcaatgcacagcgccctagcgggagcgacagaagtagacagcggagacggaaaccacatgttcgccggacacttaaaatgcaaagtccgcatggagaaactaagaataaaaggcatgagctacacaatgtgctcaggcaaattcagcatcgacaaagagatggcagaaacgcaacacggcacaaccgtagtaaaggtcaagtacgagggcgcaggcgcaccctgcaaagtaccaatcgaaataagagacgtcaacaaagagaaagtagtcggacgagtcatctcaagcacaccactggccgaaaacacaaacagtgtgacgaacatagaactcgagccgcccttcggcgacagctacatcgtaatcggagtcggaaactcagccctaacactgcactggttcaggaaaggcagcagcatcgggaaaatgttcgagagtacctacagaggcgcgaaacgaatggccatcctaggtgaaacggcatgggacttcggaagcgtaggagggctattcacctcactagggaaagcggtacaccaagtgttcggcagtgtctacacgaccatgttcgggggcgtgagctggatgataagaatactgataggcttcctagtgctatggatcgggaccaacagcagaaacacaagcatggcaatgacctgcatcgcggtagggggcataacactattcctaggcttcacagtgcaggcatga

SEQ ID NO: 2404 - RNA, 1182 nt, synthetic construct
  misc_feature 1..1182: note = derived and/or modified CDS sequence (opt11) from DENV-4 Consensus__EdelTM-variant (aa1-394)
  source 1..1182: mol_type = other RNA
atgagatgcgtaggcgtaggaaaccgcgacttcgtagaaggcgtatcaggaggagcctgggtcgacctcgtactcgaacacggaggctgcgtcacaacgatggcacaaggcaaacccacactagacttcgaactcacaaaaacaaccgccaaagaagtcgcactcttaagaacctactgcatagaagcgagcatcagcaacatcaccacagccacccgctgccccacccaaggcgaaccctacctgaaagaagaacaagaccaacaatacatctgccgaagggacgtcgtagaccgaggctggggcaacggctgcggactcttcggcaaaggcggggtcgtaacctgcgcaaaattctcctgcagtggcaaaataaccggaaacctcgtccaaatagaaaacctggaatacacagtagtcgtaacagtccacaacggcgacacccacgcagtcggcaacgacacaagcaaccacggagtcaccgcaacaataacacccaggagccccagcgtcgaggtcaaactaccagactatggagaactaaccctagactgcgagccacgaagcggaatagacttcaacgagatgatactaatgaaaatgaaaaagaaaacctggctcgtccacaaacaatggttcctcgacctccccctaccgtggaccgccggcgcagacaccagcgaagtccactggaactacaaggaaaggatggtaaccttcaaagtcccccacgcaaaacgccaagacgtgaccgtactaggctcacaagaaggagcaatgcacagcgcactagctggcgcaacagaagtagacagcggcgacggaaaccacatgttcgcgggacacctaaaatgcaaggtccgcatggaaaaactccgcataaaaggcatgtcatacaccatgtgcagcggcaaattctcaatagacaaggaaatggcagaaacacaacacggaacaacagtcgtgaaagtaaaatacgagggggccggagcaccctgcaaagtacccatcgaaataagagacgtgaacaaagaaaaagtcgtcggcagagtaataagttcaacacccctagcagaaaacacaaatagcgtgacaaacatcgaactcgagccacccttcggagactcatacatagtaataggagtcggcaacagcgcactgacactccactggttccgaaag

SEQ ID NO: 2405 - RNA, 1272 nt, synthetic construct
  misc_feature 1..1272: note = derived and/or modified CDS sequence (opt11) from DENV-4 Consensus__EdelTM-variant (aa1-424)
  source 1..1272: mol_type = other RNA
atgcgatgcgtaggagtgggtaacagagacttcgtagaaggagtaagcggaggcgcgtgggtagacctagtactagaacacggaggatgcgtaaccacaatggcacaaggaaaacccaccctagacttcgaactgaccaaaacgacagccaaagaagtcgcgctactgcgaacctactgcatagaagccagcataagcaacataacgacagcgacgagatgcccaacccagggagaaccatacctaaaagaggaacaagaccaacaatacatatgcaggcgggacgtcgtggaccgaggatggggaaacggctgcggcctatttgggaaaggaggcgtagtcacatgcgcaaaattcagctgcagcggcaaaataacagggaacctcgtacaaatagaaaacctcgaatacaccgtagtagtaacagtacacaacggagacacacacgccgtaggaaacgacacaagcaaccacggagtcacagcaacaataacaccaagaagcccaagcgtagaggtaaaactaccggactacggagaactcacattagactgcgaacccagatcaggaatagatttcaacgagatgatactgatgaaaatgaaaaagaaaacatggctcgtacacaaacaatggttcctagacctaccgctcccatggaccgcaggagcagacacaagcgaagtacactggaactacaaagagagaatggtcacattcaaagtcccacacgcaaaacgacaagacgtgacagtactcggcagccaagaaggggccatgcactccgcactagcaggagcaaccgaagtcgactcaggagacggcaaccacatgttcgcaggacacctaaaatgcaaagtacgaatggaaaaactacgaataaaaggaatgagttacacaatgtgcagcggaaagttcagtatcgacaaagaaatggcagaaacgcaacacgggacaacagtagtaaaagtaaaatacgagggagcgggcgccccctgcaaagtaccgatagaaataagagacgtaaacaaagaaaaagtagtaggaagagtcataagcagcacaccactcgcggaaaacacaaacagcgtcaccaacatagaactcgaaccaccattcggcgactcatacatagtaataggcgtaggaaacagcgcgctaaccctccactggttcaggaaaggaagcagtattggaaaaatgttcgaaagcacatacagaggcgcaaaaagaatggcgatactaggagaaactgcatgggacttcgggagc

SEQ ID NO: 2406 - RNA, 1266 nt, synthetic construct
  misc_feature 1..1266: note = derived and/or modified CDS sequence (opt11) from DENV-4 Consensus__EdelTM-variant (aa1-421)
  source 1..1266: mol_type = other RNA
atgagatgcgtaggagtagggaaccgggactttgtagaaggagtgagcggaggagcatgggtggacctagtattggaacacggagggtgtgtaacgacaatggcgcaagggaaaccgacactcgacttcgagttaacgaagacaacggcgaaagaagtggccctgctaaggacatactgcatagaagcgagcataagtaacataacgaccgcaacgagatgcccaacacagggcgaaccatatctaaaggaggagcaagatcaacagtacatatgcagaagagacgtggtggacagagggtgggggaacgggtgcgggctgttcggaaaagggggagtggtaacgtgcgcaaaattcagctgcagcggaaagataacagggaacctagtacaaatagagaacctagaatacacagtagtggtaacagtgcacaacggagacacacacgcagtcggaaacgacacgagcaaccacggggtaacggcaacaatcacgccaaggagcccgagcgtagaggtaaaactaccagactacggagaactgacgctggactgcgaaccgagaagtggaatagacttcaacgaaatgatactgatgaagatgaagaagaaaacctggctagtgcacaaacagtggttcctcgacctaccgctgccatggacagcgggggccgacacaagcgaagtgcactggaactacaaagaaaggatggtgacattcaaggtaccgcacgcgaaaaggcaagacgtaacggtactgggaagccaggaaggagcaatgcacagcgcactagcaggagcgacagaggtcgacagcggggacgggaaccacatgttcgcgggacacctaaaatgcaaagtgaggatggagaagctgagaataaagggaatgagctacaccatgtgcagtggaaagttcagtatagacaaagaaatggcggaaacgcaacatggaaccacagtagtaaaggtaaaatacgagggggcgggcgcgccatgtaaggtacccatagaaataagagacgtgaacaaggagaaagtggtggggagggtgataagcagcacaccactggcagagaacacgaacagcgtaacgaacatagaactggagccaccattcggggacagctacatagtaataggggtagggaacagcgcgctgacactacactggttccggaaaggaagcagcataggaaaaatgttcgaaagcacgtaccggggagcaaaaaggatggcaatactgggagagacagcgtgggactaa

SEQ ID NO: 2407 - RNA, 2031 nt, synthetic construct
  misc_feature 1..2031: note = derived and/or modified CDS sequence (opt11) from DENV-4 Consensus__SSc-prME
  source 1..2031: mol_type = other RNA
atgagcaccataaccctactatgcctgatacccaccgtaatggcattccacctcagcacgcgcgacggggaaccactcatgatcgttgcaaaacacgagcgcggccgcccactcctgttcaaaaccacagagggaataaacaaatgcacactcatcgccatggatctaggggaaatgtgcgaagacacagtaacatacaagtgcccgctcttggtaaacaccgaaccagaagacatcgactgctggtgcaacctcacaagcacatgggtgatgtacggaacatgcacgcagagcggagagcggcgaagagaaaaacgaagtgtcgccctaacaccccacagcggaatgggactagaaacacgagccgagacctggatgtccagcgaaggggcatggaaacacgcacaacgcgtcgagagctggatcctccgcaatcccggattcgcgttactcgcaggctttatggcatacatgatagggcagaccggaatccaacgcaccgtattcttcgtcctaatgatgctagtagcgcccagctacggaatgcgatgcgtcggcgtcggaaaccgagatttcgtagaaggcgtcagcgggggagcatgggtggacctggtcctcgaacacggcggctgcgtcaccacgatggcacaaggcaaaccgaccctggatttcgagctcacgaaaacaacagccaaagaagtagcgctactcagaacctactgcatagaagcaagcataagcaacataacaacggcaacccgctgccccacacaaggcgaaccttaccttaaagaggaacaagaccaacaatacatatgcagaagagacgtcgtcgaccgcggctggggcaacggctgcggcctattcggcaaaggaggagtagtaacctgcgcaaagttcagctgctcaggaaaaataacgggcaatttagtccaaatcgaaaacctagaatacaccgtagtagtaaccgtacacaacggcgacacgcacgcagtaggcaacgacaccagcaatcacggcgtaacagcaacaataacaccaagatccccgtcagtagaagtcaaactaccagactacggcgaactgacactagactgcgaaccaagaagcggcatagatttcaacgagatgatcctcatgaaaatgaaaaagaaaacctggctggtacacaaacagtggttcctagacctgccactaccctggacagcaggagcagacaccagcgaagtccactggaactacaaagaacgtatggtcacattcaaagtaccacacgccaagcggcaggatgtgaccgtcctaggcagccaagagggagccatgcattcagcgcttgcaggcgcaacagaagtcgactccggagacggcaaccacatgttcgcaggacacctaaaatgcaaggtcaggatggaaaagttaagaataaagggcatgtcatacaccatgtgctccggaaaattcagcatagacaaggaaatggccgaaacacagcacggaacaacagtagtcaaagtcaaatacgaaggagccggggcaccctgcaaagtacccatcgaaatacgagacgtaaacaaagaaaaagtcgtaggacgggtcatttcaagcacaccccttgccgaaaacaccaacagcgtcaccaacatagaactcgagcccccattcggagactcatacatcgtaatcggcgtgggaaacagcgccctaacacttcactggttccgcaagggaagttcaatagggaaaatgttcgaaagcacctacagaggcgccaaaagaatggcaatactaggagaaacggcctgggatttcggaagcgtaggcggactcttcacctcactaggaaaagcagtccaccaagtattcggcagcgtctacacaaccatgttcggaggagtctcatggatgatacgcatattaattggcttcctcgtcttatggatcggcaccaactcacgaaacacatcgatggccatgacctgcatcgcggtgggaggtataaccctgttcctaggcttcacggtacaagcgtaa

SEQ ID NO: 2408 - RNA, 2031 nt, synthetic construct
  misc_feature 1..2031: note = derived and/or modified CDS sequence (opt11) from DENV-4 Consensus__SSc-prME(F108S)
  source 1..2031: mol_type = other RNA
atgagcacaatcacactattgtgcctcatcccaacagtaatggcgttccacctaagtaccagagacggtgagcccctcatgatagtcgccaagcacgagagaggcagaccactactgttcaaaaccactgagggaataaacaaatgcacactcatcgccatggacctaggcgagatgtgcgaggacaccgtaacctacaaatgcccactcctagtcaacacggaaccagaagacatagactgctggtgcaacctcaccagcacatgggtcatgtacggcacatgcacacagagcggggaacgaagaagggagaagagatccgtcgcgctaaccccacacagcggcatggggctggaaacaagagcagagacgtggatgagcagtgaaggggcctggaagcatgcacaaagagtagaaagctggatactccgaaacccaggattcgcactgctagcaggattcatggcatacatgatcggacaaacggggattcagcgaacagtattcttcgtgctgatgatgctcgtcgccccgagctacggcatgcgatgtgtaggcgtcggaaaccgcgacttcgtggaaggagtaagcggaggggcatgggtagacctcgtcctggagcacggaggatgcgtcaccacaatggcacagggaaagccaactctcgacttcgagctgacgaaaacaacagccaaagaagtcgcacttctccgcacatactgcatcgaagcaagcatatccaacataacaaccgcaaccagatgcccgacacaaggagaaccctacctaaaagaagaacaagaccaacaatatatatgccgaagagacgtagtggaccgcggatggggcaacgggtgcgggctatcaggaaaaggaggcgtcgtaacgtgcgcaaaattcagctgcagtggaaaaataacgggcaacctggtgcaaatagaaaacctagaatacacggtcgtagtgaccgtccacaacggagacacccacgcagtcggcaacgacacatccaaccacggagtcacagctaccatcacacccaggagcccgtcagtggaggtaaaactcccagactatggagaactcaccctagactgcgaaccacgaagcggaatagacttcaacgaaatgatactaatgaaaatgaaaaagaaaacatggctagtgcacaaacagtggttcctagacctcccactgccgtggaccgcaggagcggacacaagcgaagtgcactggaactacaaagaacgaatggtcacattcaaagtaccccacgcaaaacgacaagacgtaacagtgctcgggagccaagaaggcgccatgcattccgcactcgcaggggcaaccgaagtagacagcggagacggaaaccacatgttcgcgggccacctcaaatgcaaagtccgaatggaaaaactacggatcaaaggaatgagctacacgatgtgcagcggcaagttctcaatcgacaaagaaatggcagaaactcagcacgggacaaccgtagtaaaggttaaatacgagggagccggagcaccatgcaaagtcccaatagaaatccgagacgtcaacaaggaaaaagtagtcgggcgagtaataagcagtacaccgctagcagagaacacaaactcagtcaccaacatagaactagaacccccattcggggactcatacatagtaataggagttggtaacagtgcactcacactacactggttcaggaaagggagtagcatcggcaaaatgttcgaatcaacatacagaggcgcaaaacgcatggcaattctgggcgagacggcgtgggacttcggcagcgtaggaggactcttcacatccctaggaaaagcggtacaccaggtcttcgggtcagtctacaccacgatgttcggaggagtaagctggatgataaggatactaataggcttcctagtactgtggatcgggacaaacagcagaaatacctcaatggcaatgacatgcatagcggtcggagggataaccctattcctcggattcacagtacaagcctag

SEQ ID NO: 2409 - RNA, 2031 nt, synthetic construct
  misc_feature 1..2031: note = derived and/or modified CDS sequence (opt11) from DENV-4 Consensus__SSc-prMEdelstem_TM-JEV
  source 1..2031: mol_type = other RNA
atgtcaaccataaccctcctatgtctcatcccgacagtaatggcattccacctaagcacacgcgacggcgaacccctcatgatcgtcgcaaaacacgaaagaggaagacccctgctgttcaaaacgacagaaggaatcaacaaatgcacactcatagccatggacctaggcgaaatgtgcgaggacacagtgacatacaagtgccccctgctagtcaacacagaaccggaagacatcgactgctggtgcaacctaacaagcacctgggtcatgtatggcacttgcacacaatcaggcgagcggcgccgcgaaaagagaagtgtcgccctcacaccccactcaggaatgggacttgaaacccgcgcggagacctggatgagctcggaaggcgcatggaaacatgcccagcgcgtagaaagctggatactccgaaaccccgggttcgccctcctggcaggcttcatggcatacatgataggacagacgggaatacagcgaacggtcttcttcgtcctgatgatgctagtagccccatcctacggaatgcgatgcgtaggcgtgggaaacagagacttcgtcgaaggcgtaagcggcggcgcatgggtcgatctagtactcgagcacggcggctgcgtaaccacaatggcccaaggaaagccgaccctagacttcgaactaacgaagaccacagccaaagaagtagccctactcagaacatactgcatagaagcgagcatctcaaacataaccaccgcaacaagatgcccaacacaaggagaaccctacctcaaagaagaacaagaccaacagtacatctgccgacgagacgtagtcgacagaggatggggaaacggctgcggcctattcggaaaaggcggcgtcgtcacatgcgcaaaattcagctgcagcggaaaaataacaggcaacctagtccaaatagagaatctggaatacaccgtcgtcgtaaccgtacacaacggagacacacacgccgtaggaaacgacacaagcaaccacggagtcaccgcaacgatcacaccacgcagccccagcgtcgaagtaaaactgccggactacggcgaactcaccctagattgcgaaccaagaagcggcatagacttcaacgaaatgatactaatgaaaatgaaaaagaaaacatggctggtacacaaacaatggtttctagacctccccctcccatggacggccggggcagacacatcggaagtgcactggaactacaaagaacgcatggtgacattcaaagttccacacgcgaaacgacaagacgtcaccgtactcggaagccaagaaggcgcgatgcacagcgcactcgccggcgcaaccgaagtcgacagcggagacggaaaccacatgttcgcaggacacctaaaatgcaaggtacgcatggagaagctcagaatcaaaggaatgagctacacgatgtgttcaggcaaattcagcatagacaaagaaatggcagaaactcaacacggaacaacggtagtcaaagtaaaatacgaaggagcaggagccccatgtaaagtcccaatagaaatccgcgacgtaaacaaagagaaagtagtaggacgagtcataagcagcacacccctggccgagaataccaactcggtcaccaacatcgaactagaaccaccattcggcgacagctacatagtaataggagtaggaaactcggcgctaacactacactggttccgaaaaggcagcacactcggaaaggcattcagcaccaccctcaagggcgcccaaaggctagcagccctcggggacacagcatgggacttcgggagcataggcggagtcttcaacagcatcggcagagcggtccaccaagtcttcggaggagcattcagaaccctcttcggaggaatgagctggataacccagggactaatgggagcgctactgctatggatgggagtaaacgcaagagaccgctccattgccttagcgttcctcgcaaccggcggcgtcctagtattcctcgcgacgaacgtacacgcatga

SEQ ID NO: 2410 - RNA, 1332 nt, synthetic construct
  misc_feature 1..1332: note = derived and/or modified CDS sequence (opt11) from DENV-4 Consensus__SSm-EdelTM
  source 1..1332: mol_type = other RNA
atgatacaaagaacggtattcttcgtactaatgatgctggtagcgccaagctacggcatgagatgcgtaggagtcgggaaccgcgacttcgtagaaggggtcagcggcggggcctgggtcgacctagtgctagaacacgggggatgcgtaaccacaatggcgcaaggaaaacccaccctagacttcgagctaacgaagacgacagcgaaagaagtcgcgctactgcgcacatactgcatcgaagcaagcatatcgaacattacgacagccacacgctgcccaacacaaggggaaccgtacctaaaagaagaacaggaccaacaatacatctgcaggcgagacgtagtggaccgaggctggggaaacgggtgcggactattcggcaaaggcggagtcgtgacctgcgccaaattctcatgctcgggcaaaatcacaggaaacctcgtacaaatagaaaacctagagtacacagtagtggtaacggtacacaacggcgacacgcatgcagtgggaaacgacacaagcaaccacggcgtgaccgcgacaataacaccacgatcacccagcgtagaagtgaagctaccggactacggagagctcacactcgactgcgaacccagaagcgggatagacttcaacgaaatgatactgatgaaaatgaagaagaaaacctggctcgtgcacaaacaatggttcctcgacctaccactaccttggacagcgggcgcggacacaagcgaggtccactggaactacaaagagagaatggtcacattcaaagtaccacacgcaaaaagacaggacgtaacagtactaggcagccaagaaggggccatgcactcggcgctggcaggagcaacggaagtcgacagcggcgacggaaaccacatgttcgcaggccatctaaaatgcaaagtaagaatggaaaaactgagaatcaaaggaatgagctacacaatgtgcagtggaaaattcagcatagacaaagaaatggcagaaacgcagcacgggacaacagtggtaaaagtaaagtatgaaggagccggcgcaccgtgcaaagtcccaatagaaataagagacgtaaacaaagagaaagtagtcggaagagtcataagctccacaccgctggcagaaaacacaaacagcgtaacaaacatagagctagaaccaccattcggagacagctacatagtgataggcgtgggaaactcagcactcacgctccactggttcagaaaaggaagcagcataggaaagatgttcgagagcacatacagaggagccaagcgaatggcaatcctcggagaaacggcatgggacttcggcagctga

SEQ ID NO: 2411 - RNA, 2376 nt, synthetic construct
  misc_feature 1..2376: note = derived and/or modified CDS sequence (opt11) from DENV-4 Consensus__C-P2A-SSc-prME
  source 1..2376: mol_type = other RNA
atgaaccaacgaaagaaagtagtgcgaccacccttcaacatgctaaagagagaacgtaacagggtatccacaccacagggactggtcaaaagattcagcaccggactcttcagcggaaaagggccactaagaatggtactcgcatttatcacattcctccgcgtcctgtcaataccaccgacagcaggcatcctaaagcggtgggggcagctgaagaaaaacaaagcaataaaaatactaatcggattcagaaaagaaataggacgaatgctcaacattctcaacggacgaaagcgcaacttcgacctgctaaaactcgcgggggacgtggagagcaaccccggaccatcaaccataacactcctatgcttaattccaacagtgatggccttccacctaagcacacgcgacggagaacccctaatgattgtagcaaaacacgagagaggcagacccctactcttcaagacaacagaaggcatcaacaagtgcaccctaatagccatggacctaggtgaaatgtgcgaagacacagtaacctataaatgcccactgctagtaaatacagaaccagaagacatagactgctggtgcaacctcacaagcacatgggtcatgtacggcacgtgcactcaaagcggcgaacgccgacgagaaaaacgatctgtggcactcaccccgcactccggcatgggactcgagacaagagcggaaacatggatgagcagtgaaggggcatggaaacacgcccagagagtcgaatcgtggatactgcgaaacccaggattcgcactgctagcaggatttatggcctacatgataggacaaacaggaatacagagaacagtattcttcgtcctgatgatgctagtcgcaccaagctacggaatgcgatgcgtgggggtaggaaacagagacttcgtagaaggagtctccggcggtgcatgggtagaccttgtcctagaacacggaggatgcgtaaccacaatggcgcaaggaaaacccacactcgacttcgaactaacgaagaccacagccaaagaagtggcactactcagaacatactgcatcgaagcatcgatctccaacataacaaccgcaaccaggtgccccacccaaggcgaaccctacctgaaggaggaacaagaccaacaatacatatgcaggcgagacgtcgtagaccgaggctggggcaacgggtgcggactattcggcaaaggcggagtagtcacatgcgccaaattctcctgcagcggcaaaatcacgggaaacctcgtccaaatcgaaaatctcgaatacactgtagtcgtaacagtccacaacggcgatacccacgccgtaggcaacgacacaagcaaccacggagtaacagcgaccatcaccccaaggagcccatccgtggaagttaaactacccgattacggggaactcacactcgactgcgaaccacgctcaggaatagactttaacgaaatgatactaatgaagatgaaaaagaaaacatggctagtacacaaacaatggttcctagacttgccgctcccatggaccgcaggagccgacaccagcgaagtgcactggaactacaaagaacgcatggtaactttcaaagtgccacatgccaaacgccaagacgtaacagtgctcggcagccaggagggagcaatgcacagtgcactagcaggggcaaccgaagtcgactcgggagatggaaaccacatgttcgcgggccacctcaaatgcaaagtaagaatggaaaagctccggatcaaggggatgagctacaccatgtgctcaggcaagttcagcatcgacaaagaaatggcagaaacccaacacggcaccaccgtggtaaaggtaaaatacgaaggcgcaggagcaccctgcaaagtccccatcgaaatcagagacgtgaacaaagagaaagtcgtagggagagtaatctcctcaacgcccctggcagaaaacaccaattcggtgaccaacatagagctggagcccccattcggcgactcctacatcgtcatcggggtaggaaacagcgcgctaaccctgcattggttccgaaaaggcagcagcatcggaaaaatgttcgaaagcacctaccgaggcgcaaagcggatggctatcctaggagaaacagcgtgggacttcggcagcgtaggcggcctgtttacatcgctaggaaaggccgtacaccaggtcttcggctccgtatacacgacaatgttcggcggcgtaagctggatgatacgcatcctaatcggctttctagtcctatggatcgggacgaacagccgcaacacaagcatggccatgacgtgcatcgcagtcggaggcatcacactcttcctcggattcaccgtacaagcctaa

SEQ ID NO: 2412 - RNA, 2043 nt, synthetic construct
  misc_feature 1..2043: note = derived and/or modified CDS sequence (opt11) from DENV-4 Consensus__SSopt-prME(F108S)
  source 1..2043: mol_type = other RNA
atgaaacgcaagaaatcaacaataacactactctgcctcataccaacagtaatggcgttccacctctccacccgagacggcgagcccctcatgatagtagccaaacacgagcgcggaaggcccctcctgttcaaaacaaccgagggcatcaacaaatgcacactaatcgccatggacctaggagagatgtgcgaagacaccgtcacttacaaatgccccctcttagtgaacacagaacccgaagacatcgactgttggtgcaacttaacatcgacatgggttatgtacgggacatgcacccaaagcggtgaacgaagaagggaaaaacgaagcgtcgcactaactccccacagcggcatggggctcgaaacacgagcagaaacctggatgagctccgaaggcgcatggaagcacgcccaaagagtggaaagctggatcctgagaaacccaggattcgccctcctcgcaggattcatggcctacatgatcggacaaactgggatacagcgcacagtattcttcgtacttatgatgctagtcgcacccagctacggcatgcggtgcgtaggcgtcgggaacagagacttcgtggaaggcgtatccggaggggcctgggtggacctagtcctagagcacggaggatgcgtaacaaccatggcccaagggaagccaaccctcgatttcgagctaaccaaaaccaccgccaaagaagtcgcacttctgcgaacatactgcatagaagcaagcataagcaacatcacaacagcgacacgatgcccaacgcaaggggagccctacttaaaagaagaacaagaccaacaatacatatgcagaagggacgtggtagaccgcggatggggaaacggctgtggactaagcggaaaaggcggagtggtaacctgcgcaaaattttcctgctccggcaaaatcacgggcaacctcgtccagatagaaaacctcgaatacacagtagtagtaacagtccacaacggagatacccacgcggtcggaaacgacaccagcaaccacggagtcacagccaccataacaccaagatcgccatccgtggaagtaaagctaccagactacggcgagctaacgctggactgcgagccaaggtcaggaatcgacttcaacgaaatgatcctgatgaaaatgaaaaagaaaacctggctagtccacaaacaatggttcctagacttaccactaccatggacagctggagccgacacgagcgaagtgcactggaactacaaagaacgaatggtcaccttcaaagtaccacacgcaaaacgacaagacgttaccgtgctaggcagccaagaaggggctatgcacagcgcactagcaggagcaacagaggtagacagcggagacggcaaccacatgttcgcggggcacctcaagtgcaaagtaagaatggagaaactacgaatcaaagggatgtcgtacacaatgtgctcaggaaaattctcaatcgacaaagagatggcagaaactcagcacggtacaacggtagtaaaagtcaagtacgaaggagccggggcaccatgcaaagtcccgatcgaaatacgcgacgtgaacaaagagaaagtcgtcggacgagtaataagctccactcccttagcagaaaacaccaactcagtaacaaacatagaactagaaccacccttcggggacagctacatcgtgatcggagtcggaaacagcgccctgaccctacactggttcaggaaaggcagcagcataggaaaaatgtttgaaagcacatacagaggagcaaaaagaatggcaatactaggggagacagcatgggacttcggctcggtgggcggactgttcacaagcctcggcaaggcagtccaccaagtattcggctcagtatacacaacaatgttcggaggagtatcatggatgataagaatactaatcggcttcctcgtcctctggatagggaccaacagccgaaacacaagcatggcaatgacctgcatagcagtaggcggaatcaccctcttcctggggttcacggtacaagcctaa

SEQ ID NO: 2413 - RNA, 2043 nt, synthetic construct
  misc_feature 1..2043: note = derived and/or modified CDS sequence (opt11) from DENV-4 Consensus__SSopt-prME(V96H)
  source 1..2043: mol_type = other RNA
atgaagcgcaagaaatcgacaataaccctgctatgcctcatcccgacggtaatggcattccacctaagcacacgagatggggagcccctcatgatcgtcgcgaaacacgaacgggggaggcccctattattcaaaacaacagagggcataaacaaatgcacgctcatcgcaatggacctaggagaaatgtgcgaggacaccgtgacatacaaatgcccattactcgtaaacacagaaccagaagacatcgactgctggtgtaacctgacaagcacgtgggtaatgtatggaacgtgcacacagtcaggggagagaagacgagaaaaacgaagcgtagccctcaccccgcactcaggaatgggactcgaaacaagagcggaaacctggatgtccagcgagggggcctggaaacacgcccagcgggtcgaatcatggatactacgaaacccaggcttcgcgttgctggcaggcttcatggcatacatgatagggcaaacaggcatacaacgaaccgtgttcttcgtactgatgatgctagtagccccgagctacggcatgcgctgcgtcggggtcgggaacagggacttcgtcgagggcgtcagcggaggagcgtgggtggacttggtactagaacacggagggtgcgtaaccacgatggcgcaagggaaaccaaccctagacttcgaactgacgaaaacgaccgccaaggaagtcgccttactcagaacatattgcatagaagcgagcatcagcaacataacaacggcgaccaggtgcccgacacagggcgaaccctatctcaaagaggaacaagatcaacagtacatatgccggcgagaccacgtggacagaggctggggaaacggatgcggactattcggaaaaggaggggtagtgacgtgcgcaaaattcagctgcagcggaaaaataactggcaacctggtccagatagaaaacctagaatacaccgtagtagtaacagtgcacaatggcgacacccacgccgtaggaaacgacacaagcaaccacggagtcacagccacgatcacccccaggagcccaagcgtggaagtaaaattaccagactacggagaactgacactggactgcgaaccacgcagcgggatagacttcaacgaaatgatactcatgaaaatgaaaaagaaaacatggctagtccacaaacaatggttcctcgacctacccctcccgtggaccgcaggcgccgacaccagcgaagtgcactggaactacaaagagcggatggttacattcaaagtcccacacgcaaaaaggcaggacgtaacggtactagggtcgcaagagggcgcaatgcacagcgccctggcgggagcaacagaggtagacagcggagacgggaaccacatgtttgcgggacacctaaaatgcaaagtacgcatggaaaaactcagaataaaaggcatgagctacaccatgtgcagcggaaagttcagcatcgacaaagagatggcggaaacgcagcatggtacaacagtcgtaaaagtgaaatacgaaggagcgggcgcgccttgcaaagtaccgatagaaatccgcgacgtcaacaaagagaaggtggtagggagagtaataagcagcacacccctggccgaaaacacaaacagcgtcacaaacatagaactcgagccaccattcggcgactcctacatcgtaatcggagtcggaaacagcgcactgaccctacactggttcaggaagggcagctcaataggaaaaatgttcgaaagcacctacaggggcgcaaaacgcatggccatacttggcgaaacagcgtgggatttcggaagcgtaggaggactcttcacaagcctagggaaagcagtgcatcaagtgttcggaagcgtatacacaacgatgttcggaggggttagctggatgatacgcatactcatagggttcctggtattatggataggcacgaacagcagaaacacgagcatggccatgacatgcatcgcagtcggcgggataacgctgttcctagggttcaccgtgcaagcgtaa

SEQ ID NO: 2414 - RNA, 2043 nt, synthetic construct
  misc_feature 1..2043: note = derived and/or modified CDS sequence (opt11) from DENV-4 Consensus__SSopt-prME(E186F)
  source 1..2043: mol_type = other RNA
atgaagagaaagaaaagcacaataaccctcctctgcctcataccaacggtgatggcgttccatctatcgacccgagacggcgaacctctaatgatagtagcgaagcacgagagaggaagaccactactcttcaaaacaaccgaaggaatcaacaaatgcacactgatagcaatggacttgggggaaatgtgcgaagataccgtcacatacaaatgcccactgctagtaaacacagaaccagaggacatcgactgctggtgcaacctcaccagcacgtgggtcatgtacggaacatgcacacaatcgggcgagcgacgaagagagaaaagaagcgtcgcactgaccccacacagcggaatgggattagaaacaagagcggagacatggatgtcaagcgaaggcgcctggaagcacgcacaacgagtagaaagctggatattaagaaacccaggcttcgccctactagcaggattcatggcgtacatgatcggacaaacaggcatacaaaggaccgtgttcttcgtcctgatgatgctggtagcaccgtcgtatggcatgagatgcgtcggagtagggaaccgggactttgtagagggcgtaagcggcggagcatgggtagacctagtgctagaacacggaggttgtgtaaccaccatggcccaagggaagccaacattggacttcgaactgaccaaaacaacagccaaagaagttgccctactcagaacatactgcatcgaggcaagcataagcaacatcacaacagccacccgatgcccaacccaaggagaaccatacctgaaagaagaacaggaccaacaatacatctgcaggcgcgacgtcgtagacagaggttggggcaacggctgcgggctgttcgggaagggaggggtagtcacgtgcgccaagttcagctgcagcgggaaaataaccgggaacctggtacaaatagagaacctcgagtacacagtagtagtaaccgtacacaacggcgacacccacgccgtgggaaacgacacaagcaaccacggagtcacggccactataacgccgagaagcccatccgtagaggtaaagctaccagactacggggagctcacactggactgctttccgagaagcggaatcgacttcaacgaaatgatactgatgaagatgaaaaagaagacctggctggtgcacaaacagtggttcctagacctcccactcccctggacggccggagccgacacaagcgaagttcactggaactacaaggaacgcatggtcacattcaaggtgccgcacgccaaacggcaagacgtcacagtcctcggatcacaagaaggagcaatgcatagcgccctggcaggagcgacggaagtggacagcggcgacgggaaccacatgtttgccggacacctcaaatgcaaagtaaggatggaaaaactgagaatcaagggaatgagctacaccatgtgcagcggcaaattcagcatagataaagaaatggcagaaacacagcacggaacaacagtggtgaaagtcaaatacgaaggcgccggcgcgccatgcaaagtaccgatagaaatcagagacgtaaacaaagagaaagtagtaggaagagtcatatcaagcacacccctagcagagaacaccaactcagtaacgaacatcgaattggaaccaccattcggagacagctacatcgtaatcggagtaggcaacagcgccctcacactgcactggttcagaaaaggaagcagcataggaaaaatgttcgaaagcacgtacagaggggcgaagcgaatggcaatcttaggcgagaccgcatgggacttcggaagcgtaggagggctattcaccagcctcgggaaagcagttcaccaggtcttcggcagtgtttacacgaccatgttcggaggtgtaagctggatgatacggatactaataggcttcctcgtgctatggatcggaaccaacagcagaaacacaagcatggcaatgacatgcatagcagtgggaggaataacactcttcctaggattcacagtacaagcgtaa

SEQ ID NO: 2415 - RNA, 2043 nt, synthetic construct
  misc_feature 1..2043: note = derived and/or modified CDS sequence (opt11) from DENV-4 Consensus__SSopt-prME(R188L)
  source 1..2043: mol_type = other RNA
atgaagcgcaagaaatccaccataacactgctctgcctcatcccaacggtcatggcattccacctaagcaccagggacggcgagccactaatgatagtcgccaaacatgaaaggggaagaccattactctttaaaacaacagaaggaatcaacaaatgcaccctaatagccatggacctgggggaaatgtgcgaagacacagtgacatacaaatgcccattgctagtgaatacagagccggaagacatcgactgctggtgcaacctcacctccacctgggtaatgtacggaacctgcacacaatcgggcgaacgccgacgcgagaaaagaagcgtagcactaacaccgcactcgggcatgggactggaaacacgagcagaaacatggatgagcagcgagggagcctggaaacacgcacaacgagtggaaagctggatactcagaaacccaggattcgccctactcgcgggattcatggcgtacatgataggacaaaccggaatccaaagaacagtattcttcgtactaatgatgctagtagcaccaagctacggcatgcgctgcgtcggggtcggaaacagagatttcgtagagggagtgagcggaggcgcctgggtagacttggtactagagcacggagggtgcgtaaccacaatggcccagggaaaaccaacactagacttcgaactcaccaaaaccacagcgaaagaagtcgccctgctcagaacctactgcatcgaagcaagtataagcaacatcaccaccgcaaccagatgcccgacacagggcgaaccctacctcaaagaagaacaagaccagcagtacatatgcagacgcgacgtagtagacagggggtggggaaatggttgcggcctattcggcaaaggaggcgtggtcacatgcgccaaattcagctgcagcggaaaaataaccgggaacctggtacagatcgaaaatctggaatacacagtggtagtaaccgtacacaatggcgacacgcacgccgtgggcaacgacacaagcaaccacggggtcacagccacaatcacccccagatcccctagcgtcgaagtaaaactaccggactacggcgaactgacactcgactgcgaaccgctatcaggcatagacttcaacgaaatgatactcatgaaaatgaaaaagaaaacatggttagtacacaaacaatggttcctcgacctacccctcccgtggacagccggagccgacacatcagaagtacactggaactacaaagaaaggatggtcaccttcaaagtcccacacgcgaaacggcaagacgtaacggtactcggctcacaagaaggcgcgatgcacagtgcgcttgccggcgcgaccgaagtcgacagcggcgatgggaaccacatgttcgccggccacttaaagtgcaaggtacgcatggaaaaactccgaatcaaaggaatgagctacacaatgtgcagcgggaaattcagcatagataaggaaatggcagaaacgcaacacgggactaccgtggtaaaagtcaagtacgaaggcgcgggagcaccctgcaaggtacccatagagatccgcgacgtgaacaaagagaaagtagtcggccgagtgatctccagtacaccgctcgccgaaaacacgaacagcgtgaccaacatcgaactggagccgcccttcggcgacagctacatagtaataggggtcgggaactccgccctaaccctccactggttcaggaaaggaagctcaatcggaaaaatgttcgaatccacgtacagaggagcaaaaagaatggccatactaggcgagaccgcatgggactttggaagcgtcggagggctattcacctcgctgggcaaagccgtccaccaagtcttcggaagcgtatacaccacaatgttcggaggcgtaagttggatgataagaatcttaatcggcttcctcgtgttatggataggaaccaacagcaggaacacgtcaatggccatgacatgcatcgcggtcggcggaataaccctcttcctaggcttcacggtgcaagcgtag

SEQ ID NO: 2416 - RNA, 2043 nt, synthetic construct
  misc_feature 1..2043: note = derived and/or modified CDS sequence (opt11) from DENV-4 Consensus__SSopt-pr(D104A)MEdelstem_TM,(F108S)-JEV
  source 1..2043: mol_type = other RNA
atgaaacgcaagaaatcaaccataacattgctatgcctcatcccaacagtcatggctttccatctcagcacgcgcgacggcgaaccactgatgatcgtcgcaaaacacgagcgcggccggcccctactgttcaaaacgaccgagggcatcaacaaatgcaccctaatagccatggacctaggggaaatgtgcgaggacaccgtaacctacaaatgccccctgctagtaaacacggaaccagaagatatcgactgctggtgcaatctaacgagtacgtgggtaatgtacggcacgtgcacccaatcaggcgaacgccggcgcgcaaaacgaagcgtagccctaaccccacactcaggaatggggctggagacacgcgccgaaacgtggatgagttcagaaggggcctggaaacacgcacaacgagtagaaagctggatccttaggaacccaggcttcgcactactcgcaggcttcatggcttacatgatagggcagacgggaatacaaaggaccgtcttcttcgtcctaatgatgctggtagcaccatcctacggaatgagatgcgtcggagtaggcaacagagactttgtcgagggcgtaagcggaggcgcgtgggtcgacctagtactcgagcatggaggatgcgtaacaacgatggcacaaggcaaaccgaccctagacttcgaactgaccaaaaccaccgccaaggaggtagccctactcagaacatactgcatagaggcctcaataagcaacatcacaacagcaacccgatgcccgacccagggcgagccatatctaaaagaggaacaagaccaacaatacatatgccgacgcgacgtagtcgatcgaggatggggcaacggctgcggtctaagcggaaaaggtggcgtggtgacatgcgcgaaattcagctgcagcgggaaaatcacaggcaacctagtccaaatagaaaacttagaatacacagtagtcgtaaccgttcacaacggagatacccacgccgtgggcaacgacacaagcaaccacggagtcaccgcgacgatcacaccgagaagcccaagcgtggaggtaaagctaccagactacggagaactaaccctagactgcgagccacgatcgggcatagactttaacgaaatgatcctgatgaaaatgaaaaagaagacatggctggtgcacaaacaatggttcctagacctaccactgccgtggacggcaggagcggacacctcggaggtccactggaactacaaagaacgtatggtaacattcaaagtcccgcacgcgaaaagacaagatgtcacagtactgggatcgcaggagggagcaatgcacagcgcgcttgcaggcgcaaccgaagtcgacagcggggacgggaaccacatgttcgccggacacctcaagtgcaaagtacgaatggaaaagctccggataaagggcatgagctacacaatgtgctcgggcaaattttcaatcgacaaagagatggccgaaacacagcacggcacgacagtagtcaaggtaaagtacgaaggggcgggcgcgccatgcaaagtacccatagaaatacgcgatgtaaacaaagaaaaagtcgtcggacgagtaatatcatccactcccctagcagaaaacacaaacagcgtgacgaacatcgaactagagccgcccttcggcgacagctacatagtgatcggggtcggaaacagcgcgctaacactgcactggttcagaaagggaagcaccctcggaaaagcattctcaaccacactcaagggcgcccaaagactcgcagccctaggcgacaccgcgtgggacttcggaagcatcggaggggtctttaattcgatcgggagagcggtccaccaagtgttcggcggcgcattcagaacactattcggaggaatgagctggataacacaggggctcatgggcgcacttctgctatggatgggagtaaacgcaagggaccgaagcatagccctagccttcctagccacaggtggagtgctggtcttcctggccacgaacgtacacgcataa

SEQ ID NO: 2417 - RNA, 2043 nt, synthetic construct
  misc_feature 1..2043: note = derived and/or modified CDS sequence (opt11) from DENV-4 Consensus__SSopt-prMEdelstem_TM,(H261N)-JEV
  source 1..2043: mol_type = other RNA
atgaagcggaagaaaagtaccatcaccctgctatgcctaatacccacagtgatggcattccatctatcgaccagagacggcgagccactaatgatagtagcaaaacacgagcgcggacgcccactcctgttcaaaaccacagaggggatcaacaaatgcaccctcatcgcaatggacctaggggagatgtgcgaagacacagtaacgtacaaatgcccccttctagtaaacaccgaacccgaagacatcgactgctggtgtaacctgacaagcacatgggtcatgtacgggacatgcacacaaagcggcgaacgaagacgagagaaaagaagcgtcgccctaacgccccacagcgggatgggactcgaaacccgcgcagaaacctggatgagttcagaaggcgcgtggaaacacgcgcaaagggtagaatcatggatactaagaaacccaggcttcgccctactagcaggattcatggcatatatgatagggcaaaccggaatccagcgcaccgtattcttcgtcctcatgatgctagtagcaccctcctacggcatgagatgcgtgggcgtcggaaacagagactttgtggaaggagtctcaggaggggcctgggtagacctagtcctagaacacggcggctgcgtaacgaccatggcacaaggcaaacccacgctcgactttgaactcaccaaaaccacagcaaaagaagtagcactcttaaggacatactgcatagaagccagcatctcaaacatcacaacagcgactagatgccccacgcaaggagaaccatacctaaaagaagaacaagaccaacaatatatatgccgacgcgacgtagtcgaccgagggtggggaaacggatgtggcctgttcggaaaaggaggagtcgtaacatgcgcgaaattctcgtgctccggaaagatcacaggcaacctagtccagatagaaaacctagagtacacagtcgtagtaacagtacacaacggagacacacacgcagtaggaaacgacacaagcaaccacggcgtaaccgcaacaatcacgccgagatcaccatcagttgaggtaaaactcccggactacggcgagctaacactcgactgcgaaccgcgaagcgggatcgacttcaacgaaatgatcctaatgaaaatgaaaaagaaaacatggctggtccacaaacaatggttcctcgacttgccattaccatggacagcaggagccgacaccagcgaagtacattggaactacaaagagcgaatggtgacattcaaagtgccacatgccaaaagacaagacgtaacggtactcggaagccaagagggcgcaatgaactccgccctcgcaggcgcaacagaggtagactccggcgacggaaatcacatgttcgcaggacacctcaaatgcaaagtacgaatggaaaaactcagaatcaaaggcatgagttacaccatgtgtagcggcaagttcagcatagacaaagaaatggcagaaacacagcacggcaccacggtagtcaaggtcaaatacgaaggcgcaggggcaccatgcaaagtccccatagaaataagagacgtaaacaaagaaaaagtagtaggacgcgtaataagcagcacacccctggcagaaaacaccaacagcgtgaccaacatcgaactagaaccacccttcggagacagctacatagtcataggagtcggaaacagcgccctaacactacactggttccgcaaaggcagcacgctgggtaaggcattctcaaccaccctaaaaggggcgcaacgactcgcagcactgggagacacagcatgggacttcggcagcataggcggggtattcaacagcatcgggagagccgtccaccaagtattcggaggagcattccgcaccctattcggcggaatgagctggataacacagggactaatgggagcactgctactatggatgggagtgaatgcacgagaccgatcaatagcactggccttcctcgccacaggaggcgtcctagtttttctagcgaccaacgtgcacgcatag

SEQ ID NO: 2418 - RNA, 2043 nt, synthetic construct
  misc_feature 1..2043: note = derived and/or modified CDS sequence (opt11) from DENV-4 Consensus__SSopt-prMEdelstem_TM,(R188L,A267T)-JEV
  source 1..2043: mol_type = other RNA
atgaaacgcaagaaaagcaccataacgctactatgcctaatcccaaccgtaatggcattccacctaagcacacgcgatggagaacctctcatgatagtagctaaacacgaaagaggcaggccgctactgtttaaaacaacagagggcatcaacaaatgcacgctaatagcaatggacctaggagaaatgtgcgaagacacagttacctacaaatgcccgctcctagtaaacacggaacccgaagacatagattgctggtgcaatctaacgagcacatgggtaatgtatggaacctgcacccaaagtggcgaacgaaggcgggagaaaagatccgtggcactgacgccccatagcggaatgggactagaaacccgggccgaaacgtggatgagcagtgaaggagcgtggaaacacgcccagcgagtggagagctggattctacgaaacccgggatttgcactactcgcgggcttcatggcatacatgatcggccaaacaggaatacaaagaacggtgttcttcgtactcatgatgctcgtagcaccgagctacggcatgcgctgcgtcggggtcggaaacagggacttcgtggaaggagtaagcgggggagcatgggtggacctcgtactggaacacggagggtgcgtaacaactatggcacaaggcaaaccaaccctagacttcgaactaacgaagacaacagcaaaggaggtcgccctactacgaacatactgcatcgaagcgtcaatcagcaatatcacaaccgcaacaaggtgcccgacgcagggagaaccctacttaaaggaggaacaagaccaacaatacatctgcagaagagacgttgttgaccgcggctggggaaatgggtgcggcctattcggaaaagggggcgtggtcacatgcgcgaaattcagttgcagcgggaaaataaccgggaacctggtacaaatagaaaacctggaatacacagtagtagtgaccgtgcacaacggggacacacacgccgtaggaaacgatacgagcaaccacggagtcacggcgacaataacacccagaagcccaagcgtcgaggtaaaactcccagactacggagaactcacactggactgcgagccactaagcggcatagactttaacgagatgatcctcatgaaaatgaagaagaaaacgtggctggtacataaacaatggttcctcgacctaccactaccgtggaccgccggggcagataccagcgaagtccactggaactacaaagaaagaatggtcacatttaaagtaccgcacgcgaaacgccaagacgtaacagtcctagggagccaggaaggagcaatgcactcagcgctcgctggcacaacagaggtagacagcggcgacggcaaccacatgttcgccggccacttaaaatgcaaggtacggatggagaagctaaggataaaaggcatgtcctacacaatgtgcagcggaaagttctccatcgacaaagaaatggcagaaacgcaacacggaaccaccgtagtcaaggtaaagtacgagggagcaggcgcaccctgcaaggtaccgatagaaataagagatgtcaacaaggagaaagtggtcgggcgagtgataagcagcacgcccctggcagaaaacacaaacagcgtaacgaacatagaactagaaccgccatttggagacagctatatcgtaatcggagtaggcaacagcgcgctgacactgcactggttcaggaaaggaagcacgctaggaaaggcgttctcgacgaccctcaagggagcgcaaaggctcgcggcgctaggtgacaccgcatgggacttcgggagcatagggggagtcttcaacagcatcggaagggcggtccaccaagtattcggaggcgccttccgaacactattcggaggcatgagctggatcacgcaaggcctcatgggcgccctcctactctggatgggcgtcaacgccagggacagaagcatagcactggcattcctagcaacaggaggagtcctagtattcctagccaccaacgtacacgcatag

SEQ ID NO: 2419 - RNA, 300 nt, synthetic construct
  misc_feature 1..300: note = derived and/or modified CDS sequence (opt11) from DENV-3 Consensus__C
  source 1..300: mol_type = other RNA
atgaacaatcaaaggaaaaagaccgggaaaccgagcataaacatgctcaagcgcgtgcgcaatcgcgtgagcacgggctcgcaattggccaagcgctttagcaagggcttgctcaatggccagggcccgatgaagctcgtgatggcgttcatagcctttctcaggttcttggccatacccccgaccgcgggcgtgctcgcgcgctggggcacgttcaagaaatcgggcgcgatcaaggtcttgaaagggttcaagaaagagatctcgaacatgctctcgatcataaacaagcgcaagaaa

SEQ ID NO: 2420 - RNA, 342 nt, synthetic construct
  misc_feature 1..342: note = derived and/or modified CDS sequence (opt11) from DENV-3 Consensus__C-SSc
  source 1..342: mol_type = other RNA
atgaacaatcaaaggaaaaagaccgggaaaccgagcataaacatgctcaagcgcgtgcgcaatcgcgtgagcacgggctcgcaattggccaagcgctttagcaagggcttgctcaatggccagggcccgatgaagctcgtgatggcgttcatagcctttctcaggttcttggccatacccccgaccgcgggcgtgctcgcgcgctggggcacgttcaagaaatcgggcgcgatcaaggtcttgaaagggttcaagaaagagatctcgaacatgctctcgatcataaacaagcgcaagaaaacgagcttgtgcttgatgatgatcttgcccgcggccttggcc

SEQ ID NO: 2421 - RNA, 273 nt, synthetic construct
  misc_feature 1..273: note = derived and/or modified CDS sequence (opt11) from DENV-3 Consensus__pr
  source 1..273: mol_type = other RNA
ttccacctcacctcccgcgacggcgaaccccgcatgatcgtcggcaaaaacgaacgcggcaaatccctcctcttcaaaaccgcctccggcatcaacatgtgcaccctcatcgccatggacctcggcgaaatgtgcgacgacaccgtcacctacaaatgcccccacatcaccgaagtcgaacccgaagacatcgactgctggtgcaacctcacctccacctgggtcacctacggcacctgcaaccaagccggcgaacaccgccgcgacaaacgc

SEQ ID NO: 2422 - RNA, 225 nt, synthetic construct
  misc_feature 1..225: note = derived and/or modified CDS sequence (opt11) from DENV-3 Consensus__M
  source 1..225: mol_type = other RNA
agcgtggccttggccccgcacgtgggcatgggcttggacacgcgcacgcaaacgtggatgagcgcggaaggggcctggcgccaggtcgagaaagtggaaacgtgggcgctcaggcacccgggctttaccatactcgcgctctttctcgcgcactatatcgggacctcgctcacgcaaaaggtcgtgatctttatcttgctcatgctcgtgaccccgagcatgacc

SEQ ID NO: 2423 - RNA, 498 nt, synthetic construct
  misc_feature 1..498: note = derived and/or modified CDS sequence (opt11) from DENV-3 Consensus__prM
  source 1..498: mol_type = other RNA
ttccacctcacctcacgcgacggcgaaccccgcatgatcgtcggcaaaaacgaacgcggcaaatccctcctcttcaaaaccgcctccggcatcaacatgtgcaccctcatcgccatggacctcggcgaaatgtgcgacgacaccgtcacctacaaatgcccccacatcaccgaagtcgaacccgaagacatcgactgctggtgcaacctcacctccacctgggtcacctacggaacctgcaaccaagccggcgaacaccgacgcgacaaacgctccgtcgccctcgcaccccacgtcggcatgggcctcgacacccgcacccaaacctggatgtcagccgaaggcgcctggcgccaagtcgaaaaagtcgaaacatgggccctccgacaccccggcttcaccatcctcgccctcttcctcgcccactacatcggcacctcactcacccaaaaagtcgtaatcttcatcctactcatgctcgtcaccccctccatgacc

SEQ ID NO: 2424 - RNA, 1479 nt, synthetic construct
  misc_feature 1..1479: note = derived and/or modified CDS sequence (opt11) from DENV-3 Consensus__E
  source 1..1479: mol_type = other RNA
atgagatgcgtcggagtcggcaacagagacttcgtagaaggcttgtcaggagccacatgggtggacgtcgtcctagaacacggcgggtgcgtaacaacgatggccaaaaacaaaccaaccctggacatcgaactgcaaaagaccgaggcaacacaactggcaacgctcaggaaactatgcatagaagggaaaatcaccaacatcaccacagacagcagatgcccaacgcagggcgaagccacactaccagaagaacaggatcaaaactacgtatgcaaacacacttacgtagacagaggttggggcaacggctgcggactcttcggaaaagggagcctagtcacatgcgcaaaattccaatgcctcgaaccaatcgaaggaaaagtagtccaatacgaaaacctaaaatacaccgtaataataacagtgcacacaggggaccaacaccaagtaggcaacgaaacgcaaggggtaacggccgaaatcacaccacaagcctcgaccacagaagcaatactaccagaatacgggaccctgggcctagaatgcagcccacggacaggcctagacttcaacgaaatgatactactcaccatgaaaaacaaagcatggatggtccaccgccagtggttcttcgacctcccactcccgtggacgagcggagccacgaccgaaacaccaacctggaaccgtaaggagctcctagtcacattcaaaaacgcgcacgcgaaaaagcaagaggtcgtagtgctcggctcacaagaaggcgcaatgcacacagcactaacaggcgcgaccgaaatccaaaacagcggagggacctcaatcttcgcaggccacctgaaatgcagactgaagatggacaaactcgaactcaaaggcatgtcctacgccatgtgcacaaacacattcgtactaaagaaagaggtctcagaaacacaacacggcacaatcctcataaaagtcgaatacaaaggcgaagacgtaccctgcaagatacccttcagcacggaagacggacagggaaaagcccacaacggaagactgatcacagccaacccagtggtcacaaagaaagaagaacccgtaaacatagaagcagaacccccattcggcgaaagcaacatcgtaatcgggatcggagacaacgccctcaaaataaactggtacaagaaagggagctcaatcggaaaaatgttcgaggccacagcccggggagcacgaaggatggcaatcctaggcgacacagcctgggacttcggaagcgtcggcggagtcctgaactcactagggaaaatggtccaccaaatctttggaagcgcctacacggccctcttcagcggagtaagctgggtcatgaaaatcggaatcggcgtactcctaacctggataggcctcaacagcaaaaacacgtcaatgagcttcagctgcatcgcgatcggcatcatcaccctgtacttaggagcggtcgtgcaagcc

SEQ ID NO: 2425 - RNA, 1977 nt, synthetic construct
  misc_feature 1..1977: note = derived and/or modified CDS sequence (opt11) from DENV-3 Consensus__prME
  source 1..1977: mol_type = other RNA
ttccacctgacctcgcgcgacggcgaacccagaatgattgtcggcaaaaacgaaagaggaaagagcttactatttaaaacggcatcaggaataaacatgtgcacgctaatcgccatggacctcggcgagatgtgcgacgacaccgtgacctacaaatgtccccacatcaccgaagtggaacccgaagacatcgattgctggtgcaacctcacaagcacgtgggtaacgtacggaacttgcaatcaagcaggcgaacacagacgcgacaaaaggagcgtcgccttagctccccacgtgggcatgggcctagacacacgaacccaaacatggatgagcgcggaaggagcatggcgacaagtagaaaaagtcgaaacctgggcgcttagacaccccggcttcaccatattagcactgttcctcgcgcactacatcgggacctcactgacgcaaaaagtcgtcatatttatcctactaatgctcgtaacaccctcaatgaccatgcgctgcgtcggggtaggaaaccgggacttcgtcgaaggattaagcggggccacatgggtggacgtggtcttagaacatggcggctgcgtaacaacgatggccaaaaacaaaccaaccctggacatcgaactacagaaaaccgaggcaacacaactagcgacgctcagaaaactatgtatcgaaggaaaaataacgaacatcacgacagacagcagatgcccaacacaaggcgaggccacactcccggaagaacaagaccaaaactacgtgtgcaaacacacgtacgtcgaccgaggctggggaaacggctgcggcctgttcgggaaaggaagtctagtcacctgtgcgaaattccaatgcctcgagccaatagaagggaaagtcgtccagtacgagaacctaaaatacaccgtaatcataaccgtacacacaggcgaccaacaccaagtgggcaacgaaacacaaggggtaacggccgagataacaccccaagcatcaaccaccgaggcaatcctacccgagtacggaacgctcggcctggaatgcagcccgcgcacaggcttggacttcaacgaaatgatactcctcacgatgaaaaataaagcgtggatggtacaccgccaatggttcttcgacctccccctaccctggaccagcggagccacaaccgagaccccaacctggaacaggaaagaactcctagttacgttcaaaaacgcgcatgcgaaaaagcaagaagtcgtggtcctaggctcgcaagaaggagcaatgcacaccgcattaacaggagcaacagaaatccaaaacagcggcgggaccagtatcttcgcgggacacctcaaatgccgcctcaaaatggacaaactagaactcaagggcatgtcgtacgcgatgtgcacaaacacattcgtactcaagaaagaagtatcggaaacgcaacatggcaccatcctaataaaggtcgagtacaaaggagaagacgtaccctgcaaaatcccattcagcacagaagatggccaaggcaaagcccacaacggccgcctgattacagcaaaccccgtcgtaacgaagaaagaggaacccgtaaacatagaggcagaaccacccttcggagagagcaacatcgtgatcggaatcggggacaacgccctaaaaataaattggtacaagaaagggtcctcaatcggaaaaatgttcgaagccacggccagaggcgcacgcaggatggcgatattaggagatacagcgtgggacttcgggagtgtcggaggcgtcctgaacagcctcggaaaaatggtacaccaaatattcggcagcgcgtacacagccctgttctcaggtgtaagctgggtcatgaaaatcggcatcggagtcctcttgacatggattggactcaacagcaaaaacacgagcatgagcttcagctgcatcgccatcgggatcataaccctgtacctgggcgcggtagtgcaagcc

SEQ ID NO: 2426 - RNA, 2019 nt, synthetic construct
  misc_feature 1..2019: note = derived and/or modified CDS sequence (opt11) from DENV-3 Consensus__SSc-prME
  source 1..2019: mol_type = other RNA
acaagcctctgcctaatgatgatcctaccggcagccctcgccttccacctcacttcacgagacggtgaaccaagaatgatcgtaggcaaaaacgaacggggcaaaagcctcctattcaaaacagcctccggcataaacatgtgcacactaatcgccatggacctaggcgaaatgtgcgacgacacagttacatacaaatgcccccacataacagaagtagagccagaagacatagactgctggtgcaatctaacaagcacatgggtaacctacggtacatgcaaccaagccggcgagcaccgaagagacaaaagaagcgtcgcactagccccgcacgtgggcatgggcctagacacacgaacgcaaacatggatgagcgcagaaggagcatggcgccaagtcgaaaaagtcgaaacctgggcacttaggcaccccggattcaccatactcgcgctattcctagcgcactacataggaacctcactaacacaaaaagtcgtgatcttcatcctactcatgctagtcacccccagtatgacaatgcgctgcgtaggggtgggaaacagagacttcgtcgaaggcctaagtggagcaacatgggtcgatgtggtcctagagcacggcggatgcgtcacaacaatggcgaaaaacaaaccgaccctggacatagaactacagaaaacagaagcaacacagctggccaccctccgaaaactatgcatcgaaggaaagatcacaaacatcacaacggacagccgctgccccacgcagggagaagcaacactaccggaagaacaagaccaaaactacgtctgcaagcacacatacgtcgatagaggctggggcaatggctgcggcctgttcggtaagggctcactcgtcacatgcgcaaaattccaatgcctggaaccgatcgaaggaaaagtggtccagtacgaaaacctcaaatacaccgtaatcatcaccgtacacacaggcgaccaacaccaagtggggaacgagacacaaggagtcactgctgaaatcacacctcaagcctcgacaaccgaagcaatcctaccagaatacggcaccctgggcctggaatgcagcccacgaacaggcttagacttcaacgagatgatacttctgaccatgaaaaacaaagcatggatggtccaccgacagtggttcttcgatctcccgttaccatggacatccggagccacaacagagaccccgacctggaacagaaaggagctcctcgtcacgttcaaaaacgcacacgccaagaaacaagaagtggtggtcctaggaagtcaagaaggagcgatgcacaccgccctcacaggcgccaccgaaatacagaactcaggaggaacgtctatattcgcaggacacctgaaatgccgtttgaaaatggacaaactcgaactcaaaggcatgtcatacgccatgtgcaccaacacatttgtcctcaagaaagaagtctcagaaacacaacacggcaccatcctaataaaagtcgaatacaaaggagaagacgtaccctgcaaaatacccttcagcacagaagacggccaaggcaaagcccacaacggacgcctgatcacagccaaccccgtagtaacaaagaaagaagaaccagtgaacatagaagcggaaccgcccttcggcgaaagcaacatcgtaattggaatcggagacaacgccctgaaaataaactggtacaagaaaggaagtagcatcgggaaaatgttcgaagcaacagcccgcggagcacgacgcatggcaatcttaggcgacaccgcctgggacttcggcagcgtgggaggtgtactgaactcgctaggcaaaatggtacaccaaatattcggctccgcctacacagccctattcagcggagtcagttgggtgatgaaaataggcatcggggtactcctgacctggatagggttaaacagcaagaatacaagcatgtccttctcatgcatagccataggaatcatcacgttatacctgggagcagtcgtccaagca

SEQ ID NO: 2427 - RNA, 1056 nt, synthetic construct
  misc_feature 1..1056: note = derived and/or modified CDS sequence (opt11) from DENV-3 Consensus__NS1
  source 1..1056: mol_type = other RNA
gacatgggctgtgtcataaactggaaaggtaaagagctcaagtgcgggagcgggatattcgtgacaaacgaggtacacacctggaccgagcaatacaaatttcaagcggactcgccaaagcgcctggcaacggcaatagcaggagcctgggagaacggcgtgtgcgggatcaggagcacgacccggatggagaacctgctctggaaacaaatagcgaacgagctaaactacatactctgggaaaataacataaaactgacagtggtcgtgggcgacatcataggagtgctcgaacaggggaaaaggaccctgaccccacaaccgatggagctcaagtactcgtggaagacctggggcaaggccaagatagtaacagcagaaacgcaaaacagctcgttcataatagacggcccgaacacgccagagtgcccgtcagtgagcagagcctggaacgtgtgggaggtcgaggactatggctttggagtgttcacgaccaacatctggctaaaactaagggaagtatacacgcaactatgcgaccacaggctcatgagcgcggccgtaaaagacgagagggccgtccacgcggacatgggctactggatagaatcgcagaaaaacgggagttggaaactggaaaaggcctcgctcatagaagtgaaaacgtgcacgtggccaaaatcgcacacgctctggagtaacggcgtgctagagagcgacatgataatcccaaaatcgctcgcgggcccgatatcacaacataaccaccgaccgggctaccacacgcaaacggccgggccctggcacctgggcaaactcgagctagacttcaactactgtgaagggacaacggtcgtgatcacggaaaactgcggaaccaggggcccgagcctgcgaacgaccacggtctcaggcaagctaatacacgagtggtgctgccggagctgtacactgcccccgctaaggtacatgggagaggacgggtgctggtacgggatggagatcagacccataagcgagaaagaggaaaacatggtgaaaagcctcgtgagcgcg

SEQ ID NO: 2428 - RNA, 1857 nt, synthetic construct
  misc_feature 1..1857: note = derived and/or modified CDS sequence (opt11) from DENV-3 Consensus__NS3
  source 1..1857: mol_type = other RNA
agcggcgtactttgggatgtaccaagcccacccgaaacacaaaaagccgaactcgaagaaggagtctaccgaatcaaacagcaaggaatcttcggcaaaacccaagtaggcgtaggcgtacaaaaagaaggagtattccacaccatgtggcacgtaacgcgaggcgccgtactaacgtacaacggaaaacgcctcgaaccgaactgggccagtgtcaagaaagacctaattagctacggcggaggatggcgacttagcgcacaatggcaaaaaggagaagaagtgcaagtaatcgcagtcgaacccgggaaaaacccgaaaaacttccagacaatgccgggcacattccagacaaccaccggagaaataggcgcaatagccctcgacttcaaaccaggaacgagcggatcacccataataaaccgagaaggcaaagtagtaggactttacggaaacggcgtcgtgaccaagaacggaggatacgtcagcggaatcgcccaaaccaacgcagaacctgacggcccgacaccagaactcgaagaagaaatgttcaagaaaagaaacctcaccatcatggacctacaccccgggagcggcaaaaccagaaaatacctccccgcaatcgtaagagaagcaataaaaagacgcctccgaacactcatcctagcaccaacccgcgtagtcgcagcagagatggaagaggcactcaaaggcctacccatcaggtaccaaacgacagcgacaaaatcagagcacaccggaagggagatagtagacctcatgtgccacgccacgttcacgatgagactcctaagtccagtcagggtaccgaactacaacttaatcatcatggacgaagcacacttcacagacccagcatccatagccgcaaggggatacatcagcacacgcgtaggaatgggcgaagccgcagccatcttcatgaccgccaccccacccgggaccgcagacgcattcccacaatcaaacgcaccaatacaagacgaagaacgagacatacccgagcgaagctggaacagcgggaacgagtggataactgacttcgcagggaaaacagtttggttcgtacccagcataaaagccggaaacgatatcgccaactgcctcagaaagaacggaaagaaagtgatccaactaagcagaaaaaccttcgatacagaataccagaaaaccaaactaaacgactgggacttcgtcgtaacgacagacataagcgaaatgggagccaacttcaaagccgaccgagtgatagaccccagacgctgcctaaaaccagtaatcctgaccgacgggccagaaagggtaatactagcgggcccaatgccagtaaccgcagcatccgccgcccaacgaagaggacgcgtcggaagaaacccccagaaagaaaacgaccaatacatcttcaccggccaaccgctcaacaacgacgaagaccacgcccactggacagaagccaaaatgctactggacaacatcaacacacccgaaggcataataccagcactcttcgaacccgaacgagagaaaagcgcagccatcgacggcgaatatcgactcaaaggagaaagcagaaaaacattcgtcgaactcatgaggcgcggtgacctaccagtatggctagcacacaaagtagcctcagaaggcatcaaatacaccgaccgaaaatggtgcttcgacggccaacggaacaatcaaatactagaagaaaacatggacgtagaaatctggacaaaagaaggcgaaaagaagaaactccgccccaggtggctagacgcccgcacatactcagacccactcgcactaaaagaatttaaagagttcgccgcaggacgcaaa

SEQ ID NO: 2429 - RNA, 2319 nt, synthetic construct
  misc_feature 1..2319: note = derived and/or modified CDS sequence (opt11) from DENV-3 Consensus__C-prME
  source 1..2319: mol_type = other RNA
atgaacaatcaaagaaagaaaaccgggaaaccaagcataaacatgctcaaacgagtacgcaaccgagtgagcacaggctcacaattggcaaaacggttctccaaaggattactcaacggccaaggccccatgaaactcgtaatggccttcatagccttcctacgattcctagccatacccccgaccgccggcgtactagcgagatggggcacgttcaagaaatcgggggcgatcaaagttctcaaaggattcaagaaagagatctcaaacatgctctcgatcattaacaaacgcaagaaaaccagcttgtgcctgatgatgatcctacccgccgccctcgccttccacctcacaagccgagacggcgaacccagaatgatagtcggcaaaaacgaaaggggaaaaagcctcctgtttaaaacagcctcgggcataaacatgtgcacgctgatagccatggatctaggggagatgtgcgacgatacagtaacctataaatgcccccacataacagaagttgaacctgaagacatcgactgctggtgcaacctaacgagcacatgggtcacatacggaacgtgcaaccaagcaggcgaacaccggagggacaagcgctccgtggcactagcgccgcacgtgggcatgggcctggacacgcgcacgcaaacgtggatgagcgcggaaggtgcctggcgacaagtcgagaaagtagaaacctgggcactacgacacccaggcttcacgattctcgcgctttttctcgcacactacatcggaacatcgctcacgcaaaaggtcgtaatatttatcctccttatgctagtcacaccatcaatgacaatgcgctgcgtaggcgtcggaaatagggatttcgtcgaaggtttaagcggggccacttgggtagacgtagtactagaacacggtggatgcgtcaccacaatggccaaaaacaaacccaccttggacatagaactgcaaaagaccgaggcaacccaactggccactcttcggaaactatgcatagaaggcaagatcaccaacataacaaccgacagcagatgccccacgcagggcgaagcaacactacccgaagaacaagaccaaaactacgtctgcaagcacacctacgtcgatagaggatggggcaatggctgcggcctattcggaaaagggagcttggtaacctgcgcgaaattccaatgcctagaaccgatcgaaggaaaagtcgtacagtacgaaaacctgaaatacaccgtgatcataaccgtccacacgggtgaccaacaccaagtaggcaacgagacacaaggagtcacggccgaaatcacaccccaggcatcgaccacagaagcaatcttacctgaatacggtactctaggcctggaatgctccccaagaacaggactcgactttaacgaaatgatcctcctgaccatgaaaaataaagcctggatggtccaccgccaatggttcttcgacctcccgctcccatggacaagcggagccacaacagagaccccgacctggaacagaaaagaactcctagtaacgttcaaaaacgcacacgctaagaaacaagaagtagtcgtactaggctcacaagaaggggcgatgcacactgcactaaccggcgcgaccgaaatacaaaattcagggggcacatcgatcttcgcaggacacctaaaatgccgactgaaaatggacaaactcgaactaaaaggcatgagctatgcaatgtgcaccaacacgttcgtcctcaagaaagaggtctcggaaacccaacacggtacgatcttaatcaaagtagagtacaaaggagaagacgtgccatgcaaaataccctttagcacggaagacggacaaggcaaagctcacaacggacgactgataaccgcaaaccccgtcgtaacgaagaaagaggaacccgtgaacatagaggccgaaccacccttcggagagagcaacatcgtgatagggataggagacaacgccttaaaaataaactggtacaagaaagggagctccatcggaaaaatgttcgaagctaccgctagaggagcgcgcagaatggcaatcctgggcgacacggcctgggatttcggctccgtgggtggcgtactaaactctctcgggaaaatggtacaccaaatattcgggagcgcatacacagcactgttctccggagtgagctgggtaatgaaaataggcataggagtcctcctcacctggatcgggctcaacagcaagaatacaagcatgagcttttcctgcatcgcgatcgggatcatcaccttatacctcggcgcggtcgtccaagcg

SEQ ID NO: 2430 - RNA, 45 nt, synthetic construct; identical to SEQ ID NO: 1670
  misc_feature 1..45: note = derived and/or modified CDS sequence (opt11) from DENV-3 Consensus__SSc
  source 1..45: mol_type = other RNA

SEQ ID NO: 2431 - RNA, 57 nt, synthetic construct
  misc_feature 1..57: note = derived and/or modified CDS sequence (opt11) from DENV-3 Consensus__SSopt
  source 1..57: mol_type = other RNA
atgaaacgcaaaaaaacctccctctgcctcatgatgatcctccccgccgccctcgcc

SEQ ID NO: 2432 - RNA, 57 nt, synthetic construct
  misc_feature 1..57: note = derived and/or modified CDS sequence (opt11) from DENV-3 Consensus__SSm
  source 1..57: mol_type = other RNA
atgacccaaaaagtcgtcatcttcatcctcctcatgctcgtcaccccctccatgacc

SEQ ID NO: 2433 - RNA, 1482 nt, synthetic construct
  misc_feature 1..1482: note = derived and/or modified CDS sequence (opt11) from DENV-3 Consensus__E
  source 1..1482: mol_type = other RNA
atgcgatgcgtcggcgtcgggaacagggacttcgtcgaaggactaagcggagcaacgtgggtggacgtggtcctagaacacggaggatgcgtaaccacaatggcgaaaaacaaaccaacactagacatagagctgcagaaaacagaggccacccaattggcaaccctaaggaaactatgcatagaaggaaaaataaccaacataacaaccgacagccgatgcccaacacaaggggaagcaacactcccggaggaacaagaccaaaactacgtatgcaagcacacgtacgtagacagaggctggggcaacggctgcggcctcttcggaaaaggcagcctagtgacatgcgcgaaattccaatgtctcgaaccaatagaaggcaaggtagtacagtacgaaaacctaaaatataccgtgataataaccgttcacacaggcgaccaacaccaagtaggcaacgaaacgcaaggggtgacggccgaaataacgccgcaagcctcaacaacagaagccatcttacccgagtacggaaccctaggcctggaatgctccccacgcacgggcctggacttcaacgagatgatactgctgaccatgaaaaacaaagcgtggatggtccaccgacagtggttcttcgacctcccactcccctggacgagcggcgccacaacagagacaccaacctggaacaggaaagaactactggtaacgttcaaaaatgcgcacgcgaagaaacaagaggtcgtagtcctaggatcgcaagagggggcgatgcacaccgcgctcacaggcgccacagagatccagaactcgggcgggacctccatcttcgcaggacacctgaaatgcaggctaaaaatggacaaactagagctcaaaggaatgtcctacgccatgtgcacaaacacgttcgtgctaaagaaagaagtatcggaaacgcaacacggcaccatactgatcaaggtcgagtacaaaggagaggacgtgccctgcaaaatacccttcagcacagaagacggacaaggaaaagcccacaacgggagactaataacagccaacccggtagtcacgaaaaaggaagaacccgtaaacatagaagcggaaccgcccttcggagaaagcaacatagtaatcgggataggagacaacgccctaaaaataaactggtacaagaaagggagctcaataggaaaaatgttcgaggccacagccaggggcgcacgaagaatggccatcctgggcgacacagcgtgggacttcggaagcgtagggggcgtgctaaactcactcggaaaaatggtccaccaaatatttggaagcgcgtacacggccctattctcgggagtaagctgggtcatgaaaataggaataggcgtactactaacctggatcggactaaacagcaagaacacaagcatgagctttagctgcatagcaatagggataatcaccctatatctaggggcagtcgtacaagcataa

SEQ ID NO: 2434 - RNA, 1176 nt, synthetic construct
  misc_feature 1..1176: note = derived and/or modified CDS sequence (opt11) from DENV-3 Consensus__EdelTM-variant (aa1-392)
  source 1..1176: mol_type = other RNA
atgcgctgcgtcggagtaggcaaccgcgacttcgtcgagggcctcagcggcgcaacatgggtcgacgtcgtcctagagcacggcggatgcgtgaccaccatggcaaaaaataaaccgaccctagacatagaattacaaaaaaccgaagcaacgcaactagcaaccctaaggaaactatgcatcgaaggcaaaatcaccaacatcacaaccgactcccgctgtccgacacaaggagaagccacgctcccagaagaacaagaccaaaactacgtctgcaaacacacatacgtagaccggggctggggaaacggctgcggcctattcggcaaaggatccctagtcacgtgcgccaaattccagtgcctagaaccaatagaaggaaaagtcgtccaatacgaaaacctcaaatacacagtcatcatcaccgtccacacaggcgaccaacaccaagtaggaaacgaaacacaaggagtcaccgccgaaatcacaccccaagcctccaccacggaagccatcctacccgagtacggaaccctaggcctcgagtgctcaccccgcaccggcctagacttcaacgaaatgatcctcctcaccatgaaaaacaaagcctggatggtccaccgccaatggtttttcgacctaccactaccctggaccagcggagccacaaccgaaaccccgacctggaaccgcaaagaactcctcgtaaccttcaaaaacgcgcacgcaaaaaaacaagaagtcgtagtcctcggatcccaagaaggcgccatgcacacagccctaaccggcgccaccgaaatccaaaactccggcggcacctcaatattcgccggccacctcaaatgccgactaaaaatggacaaactcgaactaaaaggcatgagctacgccatgtgcaccaacacattcgtcctcaaaaaagaagtctccgaaacccaacacggcaccatcctaataaaagtcgagtacaagggcgaagacgtaccatgcaaaatccccttcagcaccgaagacggccaaggcaaagcccacaacggccgactgatcacagccaacccagtcgtcacaaaaaaagaagaacccgtaaacatcgaagcagaaccacccttcggcgaatccaacatagtaatcgggataggcgacaacgccctcaaaatcaactggtacaagaaa

SEQ ID NO: 2435 - RNA, 1269 nt, synthetic construct
  misc_feature 1..1269: note = derived and/or modified CDS sequence (opt11) from DENV-3 Consensus__EdelTM-variant (aa1-422)
  source 1..1269: mol_type = other RNA
atgcgctgcgtaggagtcgggaacagagacttcgtcgaaggcctaagcggagccacatgggtcgacgtagtactagaacacggcgggtgcgtaaccacaatggccaaaaacaaacccaccctcgacatcgaactgcagaaaaccgaagcaacacaactggcaacactcaggaaactctgcatagaaggaaaaataaccaacatcacaacagatagcagatgcccgacccaaggagaagcaacactaccagaggaacaagaccaaaactacgtatgcaaacacacatatgtagaccgaggatggggcaacggctgcggactattcggaaaaggaagcctagtcacgtgcgcaaaattccagtgcctcgaacccatagaagggaaagtagtccaatacgaaaacctcaaatacacagtaataataacagtacacaccggcgaccaacaccaagtaggcaacgaaacacaaggagtcacagccgaaatcacgccccaagcgtcaacaacagaagcaatcctaccagagtacggaacactcggcctagaatgcagcccacgaacaggactcgacttcaacgaaatgatactcctgaccatgaaaaacaaagcctggatggtacaccgccaatggttcttcgacctcccgctaccatggaccagcggagccacaaccgaaacccccacctggaaccgaaaagaactactggtaacattcaaaaacgcgcacgcaaagaaacaagaagtagtagtcctaggcagccaggaaggcgcaatgcacaccgcactaaccggagcaacagaaatacaaaacagcggcgggacctcaatcttcgcaggccacctgaaatgccgactgaaaatggacaaactcgaactaaaaggaatgagctatgccatgtgcacaaacacgttcgtactcaagaaagaagtctcagaaacccaacacggcacaatcctaatcaaagtcgagtacaaaggagaagacgtgccctgcaaaataccattcagcacggaagacggccaaggaaaagcacacaacggtcgcctaatcacggccaaccccgtcgtcaccaagaaagaggaacccgtaaacatcgaagcagaaccacccttcggggagagcaacatagtaatagggatcggagacaacgccctcaaaataaactggtacaagaaaggaagctcaatcgggaaaatgttcgaagccacagcgagaggagcacgccgaatggccatcctaggcgacaccgcatgggacttcggatcctaa

SEQ ID NO: 2436 - RNA, 1260 nt, synthetic construct
  misc_feature 1..1260: note = derived and/or modified CDS sequence (opt11) from DENV-3 Consensus__EdelTM-variant (aa1-419)
  source 1..1260: mol_type = other RNA
atgcgctgcgtcggcgtaggaaacagagacttcgtcgagggcctcagcggagcaacatgggtagacgtagtactagaacacggcggatgcgtcaccacaatggccaaaaacaaacccacactggacatcgaactacagaaaaccgaagcaacacaactagccacactcaggaaactctgcatagaagggaaaataaccaacatcacaaccgacagcagatgccccacccaaggggaagccacactaccagaagaacaagaccaaaactacgtatgtaaacacacgtacgtagacagaggatggggcaacggctgcggtctattcggaaagggaagcctagtcacatgcgccaaattccaatgcctggaaccaatagaaggaaaagtagtccaatacgaaaacctaaagtacaccgtaataataacagtgcacacaggcgaccaacaccaagtgggaaacgagactcaaggagtcacagcggaaatcacaccacaagccagcaccacagaagcgatcctacccgaatacgggaccctcggactagaatgcagcccacgcacgggcctagacttcaacgaaatgatactcctcaccatgaaaaacaaagcatggatggtccaccgccaatggttcttcgacctaccactcccgtggacgagcggagccacaaccgaaacaccaacatggaacaggaaagagctattagtaacattcaaaaacgcgcacgccaagaaacaggaagtcgtagtcctaggatcacaagaaggcgccatgcacacagcactaacaggagcgacagaaatccaaaactcaggcggaacctcgatcttcgccggacacctaaaatgcagactgaaaatggacaaactcgaactcaaaggaatgagctacgcaatgtgcacaaacacattcgtactcaaaaaggaagtcagcgaaacacaacacggaacaattctaatcaaagtagaatacaaaggcgaagacgtaccctgcaaaataccattcagcacggaagacggccaagggaaggcccacaacggaagactcatcacggccaaccccgtggtcacaaagaaagaggaaccagtgaacatcgaagccgagccacccttcggagaaagtaacatcgtaatcgggatcggagacaacgccctcaaaataaactggtacaagaaagggagcagcatagggaaaatgtttgaagcgacagccaggggcgcacgaagaatggcaatactcggcgacaccgcgtgggactga

SEQ ID NO: 2437 - RNA, 1155 nt, synthetic construct
  misc_feature 1..1155: note = derived and/or modified CDS sequence (opt11) from DENV-3 Consensus__Edelaa101-107
  source 1..1155: mol_type = other RNA
atgagatgcgtaggcgtaggaaaccgcgacttcgtagaaggactatccggcgcaacatgggtcgacgtagtactcgaacacggaggctgcgtcacaaccatggccaaaaacaaacccacactcgacatcgaactccagaaaacggaagcaacacaactcgcaaccctccgcaaactctgcatcgaaggaaaaatcaccaacatcacaacagactcccgctgccccacccaaggggaagccaccctaccagaagaacaagaccaaaactacgtctgcaaacacacctacgtagaccgaggcttcggaaaaggaagcctagtaacctgcgcaaaattccaatgcctcgaacccatcgaaggaaaagtcgtccaatacgagaacctcaaatacaccgtcatcataaccgtccacacaggcgaccaacaccaagtcggcaacgaaacacaaggagtcacagccgaaatcacaccccaagcctcgaccacagaagccatactccccgagtacggaaccctcggcctagaatgcagcccgagaaccggacttgacttcaacgaaatgatactactaacaatgaaaaacaaagcctggatggtccatcgacaatggttcttcgacctcccgctcccatggaccagcggagccaccaccgaaaccccgacctggaaccggaaagagctcctagtaacattcaaaaacgcacacgcgaaaaagcaagaggtagttgtactaggctcgcaagaaggcgcaatgcacaccgcactcaccggcgccaccgagatacaaaactcaggcggaacatcgatattcgccggccacctaaaatgccgcctcaaaatggacaaactcgagctcaaaggcatgtcctacgcaatgtgcacaaacacattcgtactcaagaaagaagtctcagaaacacaacacggaacgatcctaataaaggtcgagtacaaaggcgaggacgtaccctgcaaaataccattcagcaccgaagacggccagggcaaagcccacaacggacgactcataacggccaaccccgtagtcacaaagaaagaggaacccgtgaacatcgaagccgaaccacccttcggagaaagcaacatcgtgatcggcatcggagacaacgccctaaaaataaactggtacaagaaa

SEQ ID NO: 2438 - RNA, 1173 nt, synthetic construct
  misc_feature 1..1173: note = derived and/or modified CDS sequence (opt11) from DENV-3 Consensus__EdelTM-variant (aa1-391)
  source 1..1173: mol_type = other RNA
atgcgatgcgtcggagtcggcaaccgggacttcgtcgagggcctaagcggcgccacgtgggtcgacgtcgtcctagaacacggcggatgcgtcaccactatggccaaaaacaaaccgacgcttgacatcgaactacagaaaacagaagcaacacaactagcaacactaagaaaactctgcatagaaggcaaaataacaaacatcacgaccgactccagatgccccacacaaggcgaagcaacgctcccggaagaacaagaccaaaactacgtctgcaaacacacatacgtagacagaggatggggaaacggctgcggcctgttcggaaaaggaagcctagtcacatgcgcaaaattccaatgcctcgaacccatagaaggcaaagtagtccaatacgagaacctgaaatacaccgtcatcataaccgtgcacacaggcgaccaacaccaagtaggcaacgaaacccaaggagtcacggccgaaatcacaccccaagcctcgaccacagaagcaatcctacccgaatacggaactctaggactcgaatgcagcccccgaaccggcctagacttcaacgaaatgatactcctgaccatgaaaaacaaagcctggatggtccaccgacaatggttcttcgacctcccactaccctggacctcaggcgccacaacagagacacccacctggaaccgaaaagaactcctagtcacattcaagaacgcacacgcaaagaaacaagaagtcgtagtactaggctcacaagaaggcgcaatgcataccgcactaaccggcgccacagaaatacaaaactccggcggaacctccatcttcgccggacacctcaaatgccgcctaaaaatggacaaactggaactcaaaggcatgagctacgccatgtgcaccaacacctttgtcctcaagaaagaagtatccgaaacacaacacggcacaatactaatcaaagtcgaatacaaaggagaagacgtaccctgcaaaatacccttcagcacagaagacggacaaggcaaagcacataacggccgcctcataacagccaaccccgtcgtcacaaagaaagaagaaccagtaaacatcgaagcagagccgcccttcggcgaaagcaacatcgtaatcgggataggcgacaacgccctgaaaataaactggtacaaa

SEQ ID NO: 2439 - RNA, 2025 nt, synthetic construct
  misc_feature 1..2025: note = derived and/or modified CDS sequence (opt11) from DENV-3 Consensus__SSc-prME
  source 1..2025: mol_type = other RNA
atgacctccctctgcctgatgatgatcctcccagcagcattagcattccacctaacatcccgcgacggcgaaccccggatgatagtcggcaaaaacgaaagaggaaaaagcctactattcaaaaccgccagcggcataaatatgtgcacgctcatagcgatggacctaggcgaaatgtgcgacgacaccgtgacttacaaatgcccacacatcaccgaagtggaacccgaagacatagattgctggtgcaacctaacgagcacatgggtaacctacggcacatgcaaccaagccggagaacaccgacgagacaaacgaagcgtcgcgctcgcaccacacgtcggcatggggctagacacacgaacccaaacatggatgtcagcagaaggagcatggcgccaggtcgaaaaagtcgaaacatgggctctacgccaccccggcttcaccatcctcgcactcttcctagcacattacatcggaaccagcctcacgcagaaagtcgtaatattcatactactcatgctagtcacccccagcatgaccatgcgctgcgtcggcgtcggcaacagagacttcgtagagggactaagcggagccacgtgggtagacgtcgtcctggagcacggcggctgtgtcacaacaatggccaaaaacaagccaaccctggacatagaactgcagaaaacagaagcaacacaactcgcaacactacgaaagctatgcatagaaggaaaaataaccaacataacaaccgacagcagatgccccacccaaggagaagcaaccctccctgaggaacaagaccagaactacgtgtgcaaacatacctacgtcgacagaggctggggaaacggctgtggcctgttcggaaagggatccctagtaacctgtgcgaaattccaatgcctggaaccaatcgaaggaaaagtagtacaatacgagaacctcaaatacaccgtgatcatcacagtacacaccggcgatcagcaccaagtgggtaacgagacacaaggcgtcacagccgaaataacaccccaggcctcaaccacagaagcaatcctaccagaatacgggaccctgggacttgaatgctcaccacgcacaggactggacttcaacgaaatgatcctgctaacaatgaagaacaaggcatggatggtccaccgccagtggttcttcgacctcccactaccctggacgtccggagccacaacagaaaccccaacctggaacagaaaagaacttctagtcaccttcaaaaacgcacacgcaaagaaacaagaagtcgtggtactaggctcacaagaaggagcaatgcacaccgccctcacaggagcaaccgaaatacaaaacagcggcgggaccagcatcttcgccggacacctgaaatgccgcctaaaaatggacaaactagaactaaaaggaatgtcatacgccatgtgcacaaacacattcgtgctaaagaaagaagtatccgagactcaacacggaacaatcctgataaaagtcgaatacaaaggggaagacgtaccctgtaaaatacccttcagcacagaagacggccagggcaaagcacacaacggcagattaatcacagccaaccccgtcgtaaccaagaaagaagaaccagtaaacatagaggcggaaccacccttcggagaatccaacatcgtcatagggatcggggacaacgccctgaaaataaactggtacaagaaaggaagctccatcggcaaaatgttcgaggccacggcacgaggcgcacgcagaatggccatcctaggggacaccgcgtgggacttcggatccgtcgggggagtcctcaactcactcggaaaaatggtgcaccaaatattcggaagcgcatatacggcactattctctggcgtcagctgggtaatgaaaattggcatcggcgtcctactaacatggataggactaaacagcaaaaacacaagtatgtccttcagctgcatcgctataggaatcatcacgctctatctaggcgccgtagtccaagcataa

SEQ ID NO: 2440 - RNA, 2025 nt, synthetic construct
  misc_feature 1..2025: note = derived and/or modified CDS sequence (opt11) from DENV-3 Consensus__SSc-prME(F108S)
  source 1..2025: mol_type = other RNA
atgacgtccctctgcctgatgatgatcctaccagcagcactcgccttccacctcacctcccgagacggcgaaccgagaatgatagtaggcaaaaatgaaaggggaaaaagtctactcttcaaaacggcctcaggaatcaacatgtgcaccctcattgcaatggacctcggcgaaatgtgcgacgacaccgtgacatacaaatgcccccacatcacagaagtcgaacccgaagatatagactgttggtgcaacctaacatctacatgggtgacatacggcacatgcaaccaggccggagaacatagacgagacaaaagaagcgtcgctctcgcgccccacgtcggcatgggcctcgacactcgcacacaaacatggatgtccgccgaaggggcctggcgtcaggtggaaaaagtcgaaacgtgggcactaaggcaccccggattcacaatactagcactcttcctcgcgcactacataggaactagcctcacgcaaaaagtcgtgatcttcatccttctcatgctagtaaccccatccatgacgatgcgttgtgtcggagtaggaaacagggacttcgtcgaaggactgtccggagcaacatgggtagacgtcgtcctcgagcacggtggatgcgtaaccacaatggcgaaaaacaaacccaccctggacatagaactacagaaaacagaagcaacgcaactagccaccctccggaaactctgcatagaagggaaaataacaaacataacaaccgacagccgatgcccaacacaaggagaggccacactccccgaggaacaagatcaaaactatgtatgcaaacacacctacgtagaccgcggctggggcaatggttgcggactctccggcaagggaagcctcgtcacgtgcgcaaaattccagtgcctggagcccatcgaaggcaaagtggtccaatacgaaaacctgaaatacacagtaataataaccgtccacacaggggatcaacatcaagtgggcaacgaaacgcaaggagtcacagccgaaatcacaccacaagcgtcaacaacggaagcaatcctccccgaatacggcacactgggcctagaatgcagcccgcgcacaggcctcgactttaacgagatgatactgctcacaatgaaaaacaaagcatggatggtacaccgccaatggttcttcgacctcccactaccatggacaagcggcgccaccaccgaaacaccaacatggaatagaaaagaacttctagtcaccttcaagaacgcccacgccaaaaagcaagaagtcgtagtcctcggctcacaagaaggcgcaatgcacaccgcactcacaggagccaccgaaatccagaactcaggcggaacatctatcttcgccgggcacctcaaatgccgcctaaaaatggacaaactagaactgaaaggcatgagctacgccatgtgcaccaacacattcgtgctcaagaaagaggtgtctgagacgcagcacggaactatactaataaaagtcgaatacaaaggcgaggacgttccctgcaaaataccattcagcacagaagacggccaaggcaaagcccacaacggtcgcctgatcacggccaaccccgtcgtcaccaagaaagaagaacccgtaaacatcgaggccgaaccacccttcggcgagtccaatatagtaatcggaataggggacaatgcactgaaaatcaactggtacaagaaaggaagctcaattggaaaaatgttcgaagccaccgccagaggagctcgccgcatggcaatactcggcgacactgcatgggacttcgggagcgtaggcggggtcttgaactccctcggaaaaatggtacaccaaatattcggcagcgcgtacacggcactattttcaggcgtaagctgggtcatgaaaataggaatcggagtactactcacatggatagggctcaacagcaaaaacaccagcatgagcttcagctgcatcgccatcggaataataaccctatacctaggcgcagtcgtgcaagcgtga

SEQ ID NO: 2441 - RNA, 2025 nt, synthetic construct
  misc_feature 1..2025: note = derived and/or modified CDS sequence (opt11) from DENV-3 Consensus__SSc-prME(R186L)
  source 1..2025: mol_type = other RNA
atgaccagcctatgcctgatgatgatactcccggcagcactggcattccacctgacatcccgcgacggcgagcccagaatgatagtaggcaaaaacgagcgcggaaaatcactactattcaaaaccgcctcagggataaacatgtgcacactcatagccatggacctcggagaaatgtgcgacgacaccgtaacatacaaatgtccccacataaccgaagtagaacccgaagacatcgactgctggtgcaacctgaccagcacttgggtcacctacggcacgtgcaaccaagccggcgaacacagacgggacaaacgcagcgtcgccctagccccacacgtgggcatgggactggacacccgaacacaaacgtggatgtcggcagaaggcgcatggcgccaggtcgagaaagtcgaaacatgggcactccgccacccgggcttcaccatactcgcactcttcctcgcccactacatcggcacctccctcacgcaaaaagtcgtgatattcatcctcctaatgctagtaacaccatcaatgacgatgcgatgcgtgggcgtagggaacagggacttcgtagagggcctaagcggagccacctgggtcgacgtcgtcctagaacacggcgggtgcgtgaccaccatggcgaaaaacaaaccaacgctagacatcgaactacaaaagacagaagcaacccaactggcaacgctccgaaaattgtgcatagaagggaagatcacaaacataacaacagactcaaggtgcccgacccagggcgaagcaaccctaccagaggaacaggaccagaattacgtatgcaaacacacctacgtggaccgcggctggggcaacggatgcggcctgttcggcaaaggaagcctagtcacatgcgcgaaattccaatgtcttgagcccatagagggaaaggtcgtacaatacgagaacctgaagtataccgtaatcataaccgttcacaccggcgatcaacaccaagtcggaaacgaaacacaaggcgtaacagccgaaatcacaccccaagccagcaccaccgaagccatcctacccgagtacggcacactaggccttgaatgcagcccgctcaccggactggacttcaacgagatgatactcctgaccatgaaaaacaaggcctggatggtccaccgacagtggttcttcgacctacccctaccctggaccagcggagcaacaacggagacgccaacttggaaccgaaaagaactactggtaacgttcaaaaatgcccacgccaagaaacaagaggtagtggtactcggatcacaggaaggagcaatgcacacagcactcacaggcgcaacagagatccaaaactcaggaggaacctcaatcttcgcgggacacctcaaatgccgactaaaaatggacaaactcgaactcaaaggaatgagctacgcaatgtgcaccaacacattcgtgctgaagaaagaggtatcagaaacgcaacacggcacaattttgatcaaagtcgaatacaaaggcgaagacgtcccatgcaaaataccattctccacagaagacggacaaggcaaagcccacaacggtcgactaatcactgcaaaccctgtagtaacgaagaaagaggaacccgtaaacatagaggcggaacctcccttcggcgagagcaacatagtaataggaatcggagacaacgccttgaaaataaactggtacaagaaaggatcctcgatcggcaaaatgttcgaggccaccgcaagaggcgcaagacggatggcaatcctaggagatacagcatgggatttcggcagcgtgggaggcgtcctcaactcgctcgggaaaatggtacaccaaatcttcggaagcgcttacacagccctattctcaggagtatcctgggtaatgaaaataggaataggcgtactactaacatggatcggcctcaacagcaaaaacacgagtatgtccttcagctgcatcgcaatcggcataataaccttatacctgggcgcagtcgtccaagcataa

SEQ ID NO: 2442 - RNA, 2025 nt, synthetic construct
  misc_feature 1..2025: note = derived and/or modified CDS sequence (opt11) from DENV-3 Consensus__SSc-prME(A265T)
  source 1..2025: mol_type = other RNA
atgaccagcctctgcctcatgatgatcctccccgcagccctagccttccacctcacctcgcgagacggagaaccccggatgatagtaggcaaaaacgaacgcggaaaaagtcttctcttcaaaacggcctcgggcataaacatgtgcacactcatagcaatggatcttggagaaatgtgcgacgacaccgtaacctacaaatgcccgcatatcacagaggtcgaaccagaagacatcgactgctggtgcaacctaacaagcacatgggtaacctatggaacttgcaaccaagcaggcgaacaccggcgagacaaacggagcgtagccctagcgccccacgtcggaatgggcctggacacacgcacacaaacctggatgagcgccgaaggagcatggcgccaggttgagaaagtggaaacctgggcgctccgccaccccggcttcaccatactcgcgctctttcttgcacactacatcggcaccagtctaacacaaaaagtagtgatcttcatcctactcatgctcgtaaccccgagcatgactatgcgctgcgtcggcgtcggcaacagggacttcgtcgagggcttgagcggagcaacatgggtagacgtagtactagaacacggcgggtgcgtcacaacaatggccaaaaacaaaccaaccctggacatcgaactacagaaaaccgaagcaacccaactggccacactcagaaaattatgcatagaagggaaaataaccaacatcacgacagacagccgatgcccgacccaaggcgaagccacgctcccagaagaacaagaccaaaattacgtttgtaaacacacatacgtcgacaggggatggggcaacggatgcggcctgttcggaaaaggaagcctggttacatgcgcaaaattccaatgcctagaacccatagaagggaaagtagtccaatacgagaatctaaaatacacagtcataatcaccgtacacacaggcgaccaacaccaagtaggcaacgaaacacaaggggttacggcagaaatcacaccccaagcctcaacaacggaagcaatactgcccgaatacggaaccctcggattagaatgcagccctcgtacaggcctagactttaacgaaatgatactactaaccatgaaaaacaaagcatggatggtccatagacaatggttcttcgatctcccactaccgtggacgagcggggccacaaccgaaaccccgacctggaacaggaaagagctattagtcactttcaaaaacgcgcacgcaaagaaacaagaagtcgtggtactaggttcacaagagggcgcaatgcataccgcactcacaggaaccacagaaatccaaaactcgggcgggacgtcaatatttgccgggcacttgaaatgccgactcaaaatggacaaactcgaactcaaaggcatgtcctacgcaatgtgcacgaacacattcgtactcaagaaagaagtcagcgaaacgcagcacggcacgatactaatcaaggtcgaatacaaaggcgaagacgtaccctgcaaaatacccttcagcaccgaagacggccaaggcaaggcccacaacggccgcctgataacagccaaccccgtggtcacaaagaaagaggaaccagtaaacatcgaagcagaaccacccttcggcgaaagcaacatcgtgataggaataggcgacaacgcactaaaaataaactggtacaagaaaggcagctcaatcggcaaaatgttcgaagccacggcccggggagcacgccgcatggcaatcctaggcgacacggcgtgggacttcgggagcgtcggaggagtgctcaactcgctcgggaaaatggtccaccaaatcttcggaagcgcctacacagcactattctccggagtgtcctgggtcatgaaaataggcataggagtgctactaacctggataggactaaacagcaaaaacacaagcatgagcttcagctgcatcgcaattggaattatcaccctctacctaggcgcagtcgtacaagcctaa

SEQ ID NO: 2443 - RNA, 2025 nt, synthetic construct
  misc_feature 1..2025: note = derived and/or modified CDS sequence (opt11) from DENV-3 Consensus__SSc-prMEdelstem_TM-JEV
  source 1..2025: mol_type = other RNA
atgaccagcctgtgcctcatgatgatactaccagcggcattagcattccacctcacatcacgcgacggagagccaagaatgatagtcggcaaaaacgaaaggggaaaatccctcctgtttaagaccgcctccggaatcaacatgtgcacactcatagcaatggacctcggagaaatgtgcgacgacacagtcacctacaaatgcccccacatcacggaagtcgaaccagaagacatcgactgctggtgcaatctaacaagcacgtgggtaacctacggcacatgcaaccaagcaggcgaacacagacgcgacaagcgatccgtggccctggcaccccacgtcgggatgggcctggacacccgaacccaaacatggatgtccgccgaaggagcctggcgccaagtcgaaaaagtagagacctgggcccttcgtcaccccggcttcaccatactcgcgctatttctagcccactatataggcacctccctcacacaaaaagtagtcatcttcatcctactaatgctcgtaaccccaagcatgacaatgcggtgcgtcggggtcggcaacagagacttcgtcgaaggactttccggcgccacatgggtagacgtggtactagaacacggcggatgcgtaaccacgatggccaaaaacaaaccaaccctcgacatagaactgcagaaaaccgaagccacccaactagccaccctcaggaaactatgcatcgaaggaaaaataaccaacatcaccaccgacagcagatgcccgacccaaggcgaagcaacactcccggaagaacaagaccaaaactacgtatgcaaacacacatacgtcgacagaggatggggaaacggatgcggcctgttcggaaaagggagcctggtcacatgcgcgaaattccaatgcctagaacccatcgaagggaaggtagtccaatacgaaaacctaaaatacaccgttatcataacagtacacacaggagaccaacatcaagtaggcaacgaaacgcaaggcgtaacggccgaaataacaccccaagcatccaccaccgaagccatcctcccagaatacggtacactcggcctggaatgtagcccccgcacaggcctcgacttcaacgagatgatacttctgaccatgaaaaacaaagcatggatggttcaccgacagtggttcttcgacctcccactcccatggacatccggagcaacgaccgagaccccaacctggaacagaaaggagctactcgtcacattcaaaaacgcccacgccaaaaagcaagaggtcgtggtcctaggctcccaagaaggcgctatgcacaccgcgctcacaggagcgacagagatacagaactcaggaggcacctcaatattcgccggacacctgaaatgccgcctaaaaatggacaaactcgagctcaagggcatgtcttacgccatgtgcactaacacattcgtactgaagaaagaagtctcagaaacacaacacggcacgatcctgatcaaagtcgaatacaaaggcgaggacgtaccctgcaaaatacccttctcaacagaagacggacaaggcaaagcccacaacggaagactaatcacagccaaccccgtcgtcaccaagaaagaagaacccgtcaacatcgaagccgaaccacccttcggcgagagcaacatcgtcatcggcatcggcgacaacgccctcaaaatcaactggtacaagaaaggaagtacactaggaaaggccttctcgacaacgctcaaaggtgcgcaaagactagcggcactaggcgacaccgcatgggatttcggaagcataggcggcgtcttcaactccatcggacgagccgtccaccaagtattcggcggcgcattccgaaccctcttcggcgggatgagttggataactcaaggcctcatgggcgcactcctcctctggatgggggtaaacgcaagggataggagcatagcactggccttcctcgcaaccggtggagtgctagtattcttagctacaaacgtgcacgcataa

SEQ ID NO: 2444 - RNA, 1326 nt, synthetic construct
  misc_feature 1..1326: note = derived and/or modified CDS sequence (opt11) from DENV-3 Consensus__SSm-EdelTM
  source 1..1326: mol_type = other RNA
atgacacagaaagtagtaatattcatactactcatgctcgtgaccccgagcatgacaatgagatgtgtcggggtaggaaacagggacttcgtagaaggactaagcggagccacatgggtagacgtggtactggaacacggcggatgcgtaaccacaatggccaaaaacaaaccaaccctggacatagaactacaaaagacagaggcaacacaactcgcaacactacgaaaactatgcatagaaggaaaaataaccaacatcacaacggacagcagatgcccaacccaaggagaagccacgctgccggaggaacaagaccaaaactacgtatgcaaacacacatacgtagacaggggctggggaaacggctgcggcctattcgggaaaggaagcctggtcacatgcgcaaaattccaatgcctcgaacccatagaaggcaaagtcgtccaatacgaaaaccttaaatacaccgtaatcataaccgtacacacgggagaccaacaccaagtaggcaacgaaacacaaggtgtaacagccgaaatcacaccccaggcttccacaacagaagcaatcttacccgaatacggaacactaggactagaatgcagcccgcgcaccggactagacttcaacgagatgatactcctaacaatgaaaaacaaagcgtggatggtccaccgccaatggttcttcgacctcccactaccatggacaagcggggcgacaacagaaacccccacgtggaacagaaaagaactactcgtcacattcaagaacgcacacgcgaagaaacaggaagtagtagtcctaggctcacaagagggcgcgatgcacaccgccctcacgggcgcaacagaaatccagaactcgggcggaacatcaatcttcgccggacacctgaaatgtcgcctaaaaatggacaaactcgaactcaaaggcatgagctacgcaatgtgcacgaacacgttcgtccttaagaaagaagtgtcggaaacccaacacggaacaatcttaatcaaagtggaatacaaaggagaggacgtaccctgtaaaatacccttcagcacagaagacggccagggtaaagcccacaacgggcgactaatcacagcaaaccccgtggtaacgaagaaagaagaaccagtaaacatcgaagcagaaccacccttcggcgaaagcaacatagtgatcggaataggagacaacgcactgaaaataaactggtacaagaaaggaagctcgatagggaaaatgttcgaggcgacagccagaggagcacgacgaatggcaatcctcggcgacaccgcgtgggacttcggaagctag

SEQ ID NO: 2445 - RNA, 2373 nt, synthetic construct
  misc_feature 1..2373: note = derived and/or modified CDS sequence (opt11) from DENV-3 Consensus__C-P2A-SSc-prME
  source 1..2373: mol_type = other RNA
atgaacaaccagcgcaagaaaacgggcaaaccctcgataaacatgctgaaacgagtacgcaaccgcgtctcgacaggcagccaactagcaaaacgattctcaaaaggactcctaaacggccaaggcccaatgaaactcgtcatggcattcatcgcgttcctacgcttcctagcaatacccccaacagccggcgtcctggcacgctggggcaccttcaagaaaagcggggcaatcaaagtgctaaaaggcttcaagaaagaaatcagcaacatgctcagcatcatcaacaaacgaaagaaaaacttcgacctgctcaaactagccggagacgtcgagtccaatcccggccccacaagcctgtgccttatgatgatcctacccgcagccctagcattccacctcacgagccgggatggcgaaccacgaatgatagtcggcaaaaacgaacgaggaaaaagcctactcttcaaaacagcatccggaatcaacatgtgcacactaatagccatggacctcggagaaatgtgtgacgacaccgttacatacaagtgcccacacatcacagaagtagagccggaagacatcgattgctggtgcaacctgaccagcacatgggtaacctacggaacctgcaaccaagcgggcgaacaccgacgcgacaaacggtcggtcgccctcgcgcctcacgtaggcatgggactagacacaaggacgcagacatggatgtcagcagaaggagcctggcgacaagtcgaaaaagtagaaacctgggcactccgccaccccggctttacaatactcgcactattcctagcacactatataggaaccagcctcacgcaaaaggtcgtcatcttcatcttactcatgctcgtcacaccatccatgaccatgcgctgcgtcggagtgggcaaccgggacttcgtcgagggactgagcggcgccacatgggtagacgtcgtcctagaacacggaggctgcgtgacaaccatggccaaaaacaaacccacattagacatcgaactacagaaaacagaagccacgcaactagcaacactaaggaaactatgcatagaaggcaaaataaccaacatcacgaccgactccagatgccccacccaaggcgaagccaccctccctgaagaacaagatcaaaactacgtatgcaaacacacctacgtagaccggggttggggaaacggatgcggcctcttcgggaaaggctccctagtcacatgcgccaaattccaatgcctagaaccaatcgaaggaaaggtagtacaatatgaaaacctgaaatacacggtaattataaccgtccacaccggagaccaacaccaggtaggcaacgaaacccaaggggtcaccgccgaaatcacgccccaagcctcaaccacggaagcaatcctgccagaatacggcaccctgggactagagtgcagccccagaacagggctcgacttcaacgagatgatactcttaaccatgaaaaacaaagcatggatggtacaccgccaatggttcttcgacttaccactcccatggacgagcggggcaaccacagaaacacccacatggaacagaaaagaactcttagtcaccttcaagaacgcacacgccaaaaagcaagaagtcgtagtcctaggctcacaagaaggagcaatgcacaccgccctcaccggcgcaacagagatacagaacagcggaggaacctcaatcttcgccgggcacctaaaatgcagactcaaaatggacaaacttgagctaaaaggcatgagttacgcgatgtgcacaaacaccttcgtcctcaagaaagaagtctcggaaacccaacacggcacaatcttaatcaaagtcgagtacaaaggcgaggacgtcccctgcaaaatccccttcagcacagaagacggccaaggcaaagcacacaacggcagactaatcaccgctaaccctgttgtaacaaagaaagaagaacccgtcaacatagaggcagagccacccttcggagagtccaacatcgtcatcgggatcggcgacaacgccctaaaaataaactggtacaagaaaggatcctctatcggaaaaatgttcgaggccaccgcacggggagcccgcaggatggccatactaggagacaccgcctgggacttcggaagcgtaggaggcgtcctgaactccctcgggaaaatggtccaccaaatcttcgggtccgcatacaccgcactgttcagcggcgtatcgtgggtcatgaaaataggcataggagtactcctcacctggatcggcctaaactccaaaaacacatcaatgtccttcagctgcatagctatcggaatcataaccctatacctcggcgcagtagtacaagcatag

SEQ ID NO: 2446 - RNA, 2037 nt, synthetic construct
  misc_feature 1..2037: note = derived and/or modified CDS sequence (opt11) from DENV-3 Consensus__SSopt-prME
  source 1..2037: mol_type = other RNA
atgaaacgaaagaaaacaagcctatgcctaatgatgatcctgcccgcagctctcgccttccacctcacgtcaagagacggagaaccaaggatgatagtcgggaaaaatgaacgaggcaaaagcctgcttttcaaaacagcatcaggaataaacatgtgcacgcttatcgccatggatctgggagagatgtgcgacgatacagtaacctacaaatgcccccacattacagaagtagaaccagaagacatagactgctggtgcaacctcacgtccacatgggtaacctacggcacgtgcaaccaggcgggcgagcacaggagagacaaaaggagcgtggccctagcgccacacgtgggcatgggcctggacacaaggacccaaacatggatgagcgcagaaggcgcctggcgccaggtagagaaagtagaaacgtgggcactacggcacccaggcttcaccatcctcgcgctctttcttgctcactatatcggaacaagcctcacgcaaaaagtggtgatattcatactactcatgctagtaacaccaagcatgaccatgcgctgcgtcggggtcggcaaccgagacttcgtcgaaggtttaagcggggcaacatgggtcgacgtggtgctagaacacggcggatgcgtcacaacgatggcgaaaaataagccaactctggacatagaactgcagaagacagaggccacacaacttgccacactgaggaaactatgcatcgaaggaaaaataacaaacatcaccaccgactccaggtgcccgacacagggagaagccacgctcccagaggaacaagaccaaaactacgtatgcaagcacacatacgtcgaccgcggctggggcaacggatgcggcttgttcggaaaaggaagcctagtcacgtgcgcgaaatttcaatgcctcgagccaatagaaggaaaagtagttcaatacgaaaacctaaaatacacagtcatcataaccgtacacacaggcgaccaacaccaggtgggcaacgaaacgcaaggagtaacggccgaaatcacaccccaggccagcacaacagaggcaatcctacccgaatacggaaccctaggactagaatgcagtccacgaactggattagacttcaacgagatgatactattaacaatgaaaaacaaagcatggatggtccaccgtcagtggttcttcgacctccctctaccatggacctcaggcgccacgaccgaaaccccaacctggaacagaaaagaactcctggtcacattcaaaaacgcacacgcaaagaaacaagaagtcgtagtactagggtcacaagagggtgccatgcacaccgcactaaccggggcaaccgaaatccaaaacagcggcggaacaagcatcttcgcaggtcacctcaaatgccgactaaaaatggacaaactcgagctaaaaggcatgtcgtatgccatgtgcacaaacacgttcgtactcaagaaagaggtaagcgaaacacaacacggaacaatcctaatcaaagtcgagtacaaaggggaagacgtcccctgcaaaataccattcagcacagaagacggtcaaggaaaggcacacaacggacgactcataaccgccaaccccgtagtcacaaagaaagaggaaccagtaaacatagaagcagaaccacccttcggagaatccaacatcgtcatcggaataggagacaacgcattaaaaatcaactggtacaagaaagggagttcgatcggaaaaatgttcgaagccacagctagaggcgcacgccggatggcaatcctgggcgacaccgcgtgggacttcggcagcgtgggcggggtcctcaatagcctcggcaaaatggtacaccaaatattcgggagcgcttacacagccctcttcagcggcgtcagctgggtaatgaaaatcggcatcggagtgctcctcacctggataggactaaacagcaaaaacaccagcatgagcttcagctgcatcgcaatcgggataatcacactatacctgggagcagtcgtgcaagcctaa

SEQ ID NO: 2447 - RNA, 2037 nt, synthetic construct
  misc_feature 1..2037: note = derived and/or modified CDS sequence (opt11) from DENV-3 Consensus__SSopt-prME(F108S)
  source 1..2037: mol_type = other RNA
atgaaacgtaaaaagacaagcctgtgcctgatgatgatcctccccgctgcactcgccttccacttgacatcacgcgacggcgagccccgaatgatcgtcggtaaaaacgagagaggaaaaagcctactgtttaaaacagcctccgggataaacatgtgcaccctcatagcaatggacctcggcgaaatgtgcgacgacaccgtaacttacaaatgcccacacatcaccgaagtggaaccggaagacatagactgctggtgcaacctcaccagcacatgggtaacctacggcacgtgcaaccaagccggcgaacaccgacgcgacaaaagaagcgtagccctagccccgcacgtggggatgggacttgacacacgcacgcagacatggatgagcgcagaaggagcatggcgccaagtcgaaaaagtggaaacgtgggcactcagacacccagggttcacaatactcgcactattcctcgcccactacatcggaacaagcctaacacagaaggtagtgatcttcatactactgatgctagtaacaccgagcatgactatgcgctgcgtcggcgtagggaacagggacttcgtcgaaggcctgagcggagcaacctgggtagatgtagtactagaacacggcggctgcgtcaccactatggccaaaaacaaaccaaccctagacatagaactgcagaaaacagaggcaacacaactagccacactgaggaaactgtgcatcgaaggaaaaataacaaacataacgaccgacagccggtgcccaacccaaggcgaggcaaccttaccagaagaacaagaccaaaactacgtgtgcaaacacacctacgtcgacagaggatgggggaacggatgcggactaagcggaaaaggctccctggtaacgtgcgcaaagtttcaatgcctagaacccatagagggaaaagtcgtccaatacgagaacctcaagtacacggtgatcatcacagtccacacaggcgaccaacaccaagtaggaaacgaaacacaaggcgtcacagccgaaataacaccacaggcctccaccacagaagcaatcctcccagaatacggaacactaggattggaatgcagcccccgaacgggtctggacttcaacgaaatgatactactaacaatgaaaaacaaagcgtggatggtccaccgacagtggttcttcgatttaccactcccgtggacaagcggagccacgacagagacacctacatggaaccgcaaagaactgctagtaacgtttaaaaacgcacacgcgaagaagcaagaggtcgtcgtcctaggctctcaagaaggcgcaatgcatacggccctcaccggcgcgaccgagatacaaaactccggaggaacctcaatcttcgcaggccacctcaaatgccgcctgaagatggacaaactcgagctaaaaggcatgagctatgcaatgtgcacgaacacattcgtactcaagaaagaggtctccgaaacgcaacacggcacaatcctaatcaaagtagaatacaaaggagaagacgtgccctgcaaaatccccttctcaacagaagacggacaaggcaaagcacacaacgggcgcctcataacagcaaatcctgtagtcacaaagaaagaggaaccagtaaacatagaggcagaaccacccttcggagaaagcaacatcgtaatcggaataggcgacaatgcgttgaaaataaactggtacaagaaagggtcatcaatcgggaaaatgttcgaagccacggcgcggggcgcacgccgaatggcaattctcggcgacaccgcctgggatttcggaagcgtaggaggagtcctaaactcgctaggaaaaatggtccaccaaatattcggaagtgcatacactgcgttattcagcggcgtgagctgggtaatgaaaatcggcataggagtactcctgacctggataggcctcaacagcaaaaacacaagcatgtccttcagctgcatcgccatcggcatcatcacactctacttaggcgccgtcgtccaagcataa

SEQ ID NO: 2448 - RNA, 2037 nt, synthetic construct
  misc_feature 1..2037: note = derived and/or modified CDS sequence (opt11) from DENV-3 Consensus__SSopt-prME(H27N)
  source 1..2037: mol_type = other RNA
atgaaacgcaagaaaacgagcctatgcctaatgatgatcctacccgcagccctggccttccacctaacatcacgagacggcgaaccaagaatgatagtcgggaaaaacgagaggggcaaaagcctgctattcaaaacggcatccggaataaacatgtgcacgctcatagcaatggacctaggagaaatgtgcgacgacaccgtaacctacaaatgtccccacatcaccgaagtagaaccagaagacatcgactgctggtgcaacctaacatccacatgggtcacctatggcacgtgcaaccaagcaggagaacaccggcgcgacaaaagaagcgtagccttggccccgcacgtaggcatgggcttagacacgcgaacgcaaacgtggatgagcgcagaaggggcctggcgacaagtagagaaagtagaaacatgggcactcaggcacccagggtttaccatactcgccctcttcctcgcgcactacataggaacctcactcacgcaaaaagtcgtgattttcatcctactcatgctcgtaacaccaagcatgaccatgcgatgcgtcggcgtagggaacagagacttcgtagaaggcctaagtggggcaacctgggtagacgtggtcctagagaatggcgggtgcgtaaccacgatggcgaaaaacaaaccaaccctggacattgagctccagaaaacggaggccacgcaattggccacactcaggaaattatgcatagagggaaaaataaccaacataacaaccgacagtagatgcccaacccaaggggaagcaacgctcccggaagaacaagaccaaaactacgtgtgcaagcatacctacgtagacagaggctggggcaacggctgcggcttattcggaaaaggcagcctggtcacgtgcgccaaattccaatgcctagagcccatagaagggaaagtagtccaatacgaaaacctgaaatacaccgtaatcatcaccgtacacacaggcgaccaacaccaagtaggaaacgaaacgcagggagtaacagccgaaataacaccccaggcctccacaacagaagcaatactgcccgaatacggcaccctcggcctagaatgcagcccgcgcacaggactagacttcaacgagatgatactcctcacaatgaaaaacaaggcgtggatggtacaccgacaatggttcttcgacctcccactcccgtggacaagtggggccacaaccgaaaccccaacctggaaccgaaaagaactcctagtcaccttcaaaaacgcacacgccaagaaacaagaagtcgtcgtactaggttcacaagaaggagccatgcacaccgcgctaaccggtgccaccgaaatccaaaactccggagggacttccatctttgccggacacctcaaatgccgcctgaaaatggacaaactcgaactcaagggcatgtcttacgcaatgtgtacaaacacattcgtactcaagaaagaagttagcgagacccaacacggcaccattctgatcaaagtagagtacaaaggcgaagatgtaccctgcaaaataccgttcagtaccgaagacggccaaggcaaagcccacaacggccggctaataacggccaaccccgtggtaaccaagaaagaagaacccgtaaacatagaagcagaaccaccctttggcgaatccaacatcgtaatcgggatcggggacaacgccctcaaaatcaactggtacaagaaaggcagctcaatcggaaaaatgttcgaggctacggcaagaggagcccgcagaatggcaatcctcggagacacagcctgggacttcggatccgtgggcggagtcctaaactccctcggaaaaatggtacaccaaatattcggaagcgcatacacggctctatttagtggcgtgagctgggtaatgaaaataggcataggagttctcctgacatggatcgggttaaactccaaaaacacgagcatgagcttcagctgcatagccatcgggataataaccctatacctaggagcagttgtccaagcatga

SEQ ID NO: 2449 - RNA, 2037 nt, synthetic construct
  misc_feature 1..2037: note = derived and/or modified CDS sequence (opt11) from DENV-3 Consensus__SSopt-prME(T76I)
  source 1..2037: mol_type = other RNA
atgaaacgaaagaaaacgagtctctgcctcatgatgatactacccgccgccctagcattccatctaacatcaagagacggagagcccaggatgatagtcgggaaaaacgaacgcggtaaatccttactcttcaaaacagcctccggcatcaacatgtgcacactcatagccatggacctcggcgaaatgtgcgacgacactgttacctacaaatgcccccacatcacagaagttgaacccgaagacattgactgttggtgcaacctaacaagtacatgggtcacatacggaacatgcaatcaagcaggcgagcacagacgcgacaaaaggagcgtggccctggccccgcacgtggggatgggactcgacacccgtacacagacatggatgagcgcagaaggagcctggcggcaagtagagaaagtcgaaacctgggccctcagacaccctggcttcaccatacttgcactcttcctcgcgcactacataggaacatcactgacacaaaaggtagtaatctttatcctcctaatgctcgtgaccccatcgatgactatgcgatgcgtcggagttgggaacagggacttcgtcgaaggcctcagcggcgctacatgggtcgacgtagtcctcgaacacggaggctgcgtaaccaccatggccaaaaacaaacccaccctagacatagaattgcaaaagactgaagccacccaactggccaccctacgcaaactatgcatagagggaaaaataaccaacatcacaacagactccagatgcccaatccagggagaagcaacactacccgaagaacaagaccaaaactacgtctgcaaacacacctacgtcgaccgcggctggggaaacggatgcggcctattcggaaaaggatccctcgttacgtgtgcaaaattccaatgcctcgaaccaattgaaggaaaagtagtccaatacgaaaacctgaaatacaccgtcatcataaccgtacacaccggcgatcaacaccaagtaggcaacgaaacacaaggcgtaacagcagaaataacaccacaagcctcgactaccgaagcaatactccccgaatacgggaccttaggactggaatgcagcccacgcaccggcctagacttcaacgagatgatcctactgacgatgaaaaacaaagcctggatggtacacaggcaatggttcttcgatctccccttaccctggacgagcggagcaacaaccgaaaccccaacatggaaccgcaaggaactcctggtcacgttcaagaacgcgcacgcgaagaaacaagaggtcgtagtcctgggctcacaagagggcgcgatgcatacagccctcaccggcgcgaccgaaatccaaaactccggcgggacaagcatctttgcaggacacttaaaatgccgcctgaaaatggacaaactcgaactcaaaggaatgtcctacgcaatgtgcacgaacacattcgtgctaaagaaagaagtcagcgaaacacaacacggaacgatcctaatcaaagtcgaatacaaaggggaagacgtgccctgcaaaatccccttcagtacagaagacggccaaggaaaggcacacaacggacgccttatcactgccaaccccgtggtcaccaagaaagaagaaccagtgaacatagaagcagaaccaccattcggcgaaagcaacatcgtcatcggaatcggcgacaacgccctaaaaatcaactggtacaagaaaggcagctcgataggaaaaatgttcgaagccacggcaagaggcgcgagaagaatggcgatactaggcgacaccgcatgggacttcggaagcgtaggcggagtcctcaactcactcggcaaaatggtacaccaaatcttcggttccgcctacacggccctcttctcaggcgtaagctgggttatgaaaataggcataggcgtgctcctaacatggatcggcctcaacagcaaaaacacaagcatgagcttctcctgcatcgcaatagggatcatcaccctatacctcggcgcagtcgtgcaagcatga

SEQ ID NO: 2450 - RNA, 2037 nt, synthetic construct
  misc_feature 1..2037: note = derived and/or modified CDS sequence (opt11) from DENV-3 Consensus__SSopt-prME(N89D)
  source 1..2037: mol_type = other RNA
atgaaacgtaagaaaacgagcctctgtctaatgatgatactacccgctgccctagcattccatctcacctcacgcgacggcgagcccaggatgatagtaggcaaaaacgaaaggggaaaaagcctactgttcaaaaccgcctcaggaataaacatgtgcaccctaatcgcaatggaccttggggaaatgtgcgacgacacagtaacatacaaatgtccacacatcacagaagtagaaccagaagacatagactgctggtgcaaccttacgagcacgtgggtaacctacggaacgtgcaaccaagcgggagagcaccgaagagataaacgaagcgtggcactagcaccacacgtaggaatggggctggacacgcgaacacaaacatggatgagcgccgaaggagcatggagacaagtcgagaaagtagaaacgtgggcactcaggcacccaggcttcaccatactggccctcttcctcgcgcactatatagggacctcactgacccaaaaggtagtaatatttattttactaatgctagtaaccccgagcatgaccatgcgatgcgtaggagtcgggaacagggacttcgtcgagggcctaagcggcgcaacgtgggtagacgtggtcctcgaacatggaggctgcgtcaccacaatggcgaaaaataaaccaacactagacatagaactacaaaagaccgaggccacccaactagccacgctaagaaaactatgcatcgagggaaaaataactaacatcacaacagacagccgatgcccaacgcagggggaggcaacactcccagaggaacaagaccaagactacgtatgcaaacacacatacgtggacaggggatggggcaacggatgcggtctattcgggaaaggaagcctcgtcacgtgcgcaaaattccaatgcctcgaaccgatagaagggaaagtagtccaatacgaaaacctaaaatacacagtgataataacagtacacacaggcgaccaacaccaggtgggcaatgaaacgcaaggggtaacggcggagatcacaccccaggcatcaaccacggaagcaatcctaccagagtacggcacactaggcctcgaatgcagcccgcgcacagggctagacttcaacgagatgatcctactaacaatgaaaaacaaggcctggatggtacaccgacagtggttcttcgacctcccgctaccatggacatcaggggcaacaaccgaaacccccacctggaaccggaaagagctcctagtcacattcaagaacgcccacgcaaagaaacaagaagtcgtagtcctaggcagccaagaaggagccatgcataccgcactaactggcgccaccgaaatacaaaactcaggcggcacctcaatcttcgccggacacttgaaatgccgactaaaaatggacaaactagaactaaaaggcatgagctacgcaatgtgcacgaatacattcgtgctcaaaaaggaagtatcagaaacgcagcacggcacgatccttatcaaagtcgagtacaaaggagaagacgtaccatgcaagatacccttctccacggaagacggccaaggcaaggcacacaacggcagactgatcacagcaaacccagtggtaacgaagaaggaagaaccagtaaatatagaagcagaaccacccttcggcgaaagcaacatcgtcatcggaatcggagacaacgccctaaaaattaactggtacaaaaagggaagttcgatagggaaaatgttcgaagccacagccagaggcgcacgcagaatggcaatcctaggtgatacagcctgggatttcgggagcgtgggcggagtcctaaactcgctagggaagatggtccaccaaatattcgggagcgcatacacagccctattcagcggcgtaagctgggtaatgaagatcggcataggcgtactactaacgtggatcggcctaaacagcaaaaacaccagcatgagcttcagctgcatagcaatcggcatcataacactatacctcggtgcggtagtacaagcctaa

SEQ ID NO: 2451 - RNA, 2037 nt, synthetic construct
  misc_feature 1..2037: note = derived and/or modified CDS sequence (opt11) from DENV-3 Consensus__SSopt-prME(Y96H)
  source 1..2037: mol_type = other RNA
atgaaaagaaagaaaactagcctatgcctaatgatgatactccccgccgccctagccttccacctcacgtcccgagacggagagccccgaatgatagtcggcaaaaacgagaggggaaaatcactactcttcaaaacagcatccgggataaacatgtgcacactaatagccatggacctaggagaaatgtgcgacgacacagtaacctacaaatgcccacacatcaccgaagtcgaaccagaagacatagactgctggtgcaacctaacctcaacctgggtaacctacggaacctgcaaccaagcgggcgagcacagacgcgacaaaagaagcgtagcgctcgcaccccacgtgggcatgggcctggacacacgaacccaaacgtggatgagcgccgaaggcgcctggcgccaagtagagaaagtagaaacttgggcactgcggcacccaggattcacaatactagcactcttcctcgcgcactacatcggaacctcactcactcaaaaagtcgtaatattcatcctgctaatgctagtaaccccgagcatgaccatgcgctgcgtcggagtaggaaaccgggacttcgtcgagggcctgagcggggcaacatgggtggacgtagtcctcgaacacggcggatgcgtgacaaccatggcgaaaaacaaaccaaccctagacatagaactacagaaaaccgaagccacccaactcgccaccctcagaaaactatgcatagagggcaaaattaccaacatcaccaccgacagcagatgcccgacacaaggcgaagccaccctccccgaagaacaagaccaaaactacgtatgcaaacacacacacgtagaccggggctggggcaacggctgcggcctgtttgggaaaggcagcctggtcacgtgcgccaaattccaatgtctcgaacccatagagggaaaagtcgtccaatacgaaaacctcaaatacacagtcatcatcaccgtgcacacaggcgaccaacaccaggtaggcaacgaaacacagggagtcaccgccgaaatcacaccacaagcatccaccaccgaagccatactaccagaatacggaaccctcggactcgaatgctcaccacgaacgggtctggactttaacgaaatgattctcctgaccatgaaaaacaaagcatggatggtccaccgacaatggttctttgacctccccctaccatggacaagcggagccacaaccgaaacacccacctggaaccgtaaggaactcctggtcacgtttaagaacgcacacgcaaagaaacaagaagtggtagtactcggctcccaagaaggcgcgatgcacaccgcccttaccggagccaccgaaatccaaaacagcggcggcacctcgatattcgccggccacctcaaatgccgcttaaaaatggacaaactcgaactcaaaggaatgagctacgcaatgtgcaccaacaccttcgtcctgaagaaagaagtctctgaaacacaacacggtacaatcctcataaaagtcgaatacaaaggagaggacgtcccatgcaaaatcccattcagcacggaggacggccagggcaaagcacacaacgggcgcctaatcaccgccaacccggtcgtaacaaagaaagaggaacccgtaaacattgaagccgaaccaccattcggcgagagcaatatcgtaattggcataggagacaatgccctgaaaataaactggtacaagaaagggagctccatcggcaaaatgttcgaagccacagctcggggcgcacggcggatggcaatactaggagacacagcatgggacttcggctcagtaggcggagtccttaacagcctcgggaaaatggtccaccaaatcttcggctcagcatacaccgccctgttcagcggagtctcatgggttatgaaaatcggcatcggcgtgctcttaacatggatagggctaaacagcaaaaacacctccatgagcttcagctgtatcgccatcggaatcatcaccttatacctcggagcggtcgtacaagcctaa

SEQ ID NO: 2452 - RNA, 2037 nt, synthetic construct
  misc_feature 1..2037: note = derived and/or modified CDS sequence (opt11) from DENV-3 Consensus__SSopt-prME(K110E)
  source 1..2037: mol_type = other RNA
atgaagagaaagaaaacaagcctatgcctaatgatgatcctgcccgcagccctcgcattccacctaacaagccgcgatggcgaacctagaatgatagtcggcaaaaacgaaagaggcaaaagcctactcttcaaaacagcctcaggaattaacatgtgcacgctaatcgcaatggatctgggcgagatgtgtgacgacacagtgacctataaatgcccccatatcacggaagtggaaccagaagacatcgactgctggtgcaacttaacgagtacctgggtcacctacggcacatgcaatcaggccggcgagcaccggcgcgacaaaaggagcgtggccctggctccgcacgtaggcatgggcctggacacacgcacacaaacatggatgagcgcggaaggagcctggcgacaagtagaaaaagtagagacatgggcactcagacacccaggctttaccatactcgcgctctttctcgcgcactacatagggacctcactaacacaaaaagtcgtaatattcatcctactaatgctcgtaaccccaagcatgacgatgcgctgcgtcggcgtcggcaaccgggacttcgtagagggcctaagcggggccacctgggtggacgtggtcctagaacacggcggctgcgtgaccacgatggcgaaaaacaagccaaccctagacatagaactacagaaaaccgaggccacacaactggccaccctcagaaaactatgcatagaaggaaaaatcacaaacataacgacagactcaaggtgcccaacacaaggcgaagccacactaccggaggaacaagaccaaaactatgtatgcaagcacacatacgtggacagaggatggggcaacggctgcggactgttcggcgaaggaagcctcgtcacatgcgcaaaattccaatgcctagaacccatcgaaggaaaagtggtgcaatacgagaaccttaaatacaccgtgatcataaccgtacacaccggagaccaacaccaagtgggcaacgaaacacaaggagtcacggccgaaatcacaccacaagcaagcaccacggaagcaatcttgcccgagtacgggaccttaggccttgaatgcagcccacgcacgggactggacttcaacgaaatgatactcctaacgatgaaaaacaaagcgtggatggtacaccgacaatggttcttcgacctcccacttccctggacgagcggagcaacaacagagaccccgacttggaacagaaaagagctgctagtaacattcaagaacgcccacgcaaagaaacaagaggtcgtggtcctgggcagccaagaaggcgcgatgcacacagcgctcacaggagcgaccgaaatccaaaacagcgggggaaccagcatcttcgccggtcacctgaaatgccgactgaaaatggacaaactcgaactcaaaggaatgagctacgcaatgtgtacaaacacgttcgtactcaagaaagaagtctcagaaacgcaacacggcacaatactaatcaaggtcgaatacaaaggcgaggacgtaccatgcaaaatcccctttagcacagaagacggccaaggaaaagcacacaacggaagactcatcaccgcaaatccagtggtaacgaaaaaggaagaacccgtcaacatagaggcagaaccaccctttggcgaaagcaacatcgtcatcggaataggagacaacgcactgaagatcaactggtacaagaaaggaagctcgatcgggaaaatgttcgaagcaactgcaagaggcgcccgccgaatggcgatcctgggcgacacagcatgggacttcgggagcgtaggaggggtcctaaactcgctcgggaaaatggtccaccaaatcttcgggagcgcatacacggctctgttctcaggagtcagctgggtgatgaaaataggcataggcgtgctcttgacatggatcggactaaattccaaaaacacgagcatgagcttcagttgcatcgccataggaatcataacactatacctgggcgcagtagtacaagcgtaa

SEQ ID NO: 2453 - RNA, 2037 nt, synthetic construct
  misc_feature 1..2037: note = derived and/or modified CDS sequence (opt11) from DENV-3 Consensus__SSopt-prME(H149N)
  source 1..2037: mol_type = other RNA
atgaaacgaaagaaaacaagcctgtgtttaatgatgatcctacccgccgccctggccttccaccttacatccagagacggagaaccacgaatgatcgtaggcaaaaacgaaagaggcaaaagccttctcttcaaaaccgcttcgggcataaacatgtgcacgctcatagccatggacttgggtgaaatgtgcgacgacacagtcacctacaaatgcccccacatcacagaagttgagccggaagacatagactgctggtgtaacctcaccagcacgtgggtgacctacgggacctgcaaccaagcaggcgaacaccgaagagacaaacgaagcgttgccctggcgccccacgtcggcatgggcctggacacgcgcactcaaacatggatgagcgcggaaggagcatggcgccaggtagaaaaagtggagacatgggcgctcaggcacccaggcttcacaatactcgcactcttcctagcgcactacatcggcaccagcctcacgcaaaaggtcgtaatcttcatactgctcatgctcgttacaccaagcatgacaatgcgctgcgtaggagtcggaaacagagacttcgtagaaggactaagcggagccacatgggtagacgtggtcctggaacacggcggatgcgtaaccacgatggcgaaaaacaaaccaacactagacatagagctgcagaaaacagaagctacgcaactagccaccctaaggaaactgtgcatagaagggaaaatcaccaacatcacaaccgacagccgatgcccgacgcaaggcgaagcaacgctcccggaggaacaagaccaaaattatgtgtgcaaacacacctacgtagaccgaggctggggcaacggctgtggactattcggaaaagggagcctagtaacatgcgcgaaattccaatgtctcgaaccaatagagggcaaagtagtccaatacgaaaacctaaaatacaccgtcatcataacagtgcacacgggcgaccaaaatcaagtcggcaatgaaacccaaggagtcacagcagaaataacaccccaggcaagcaccaccgaagcaatcctacccgaatacgggaccctcggactagaatgcagcccacgcaccggcctagacttcaacgaaatgattctcctgaccatgaaaaacaaagcgtggatggtccaccgacagtggttcttcgatctccccctcccatggaccagcggggccacgacggagaccccaacctggaacaggaaagagctcctagtcacgttcaagaacgcacacgccaagaaacaagaggtcgtagtcctaggctcgcaagagggcgccatgcacaccgcactaacgggggcaaccgaaatacaaaactcgggcggaacctcgatcttcgcaggacacctgaaatgccgcctaaaaatggacaagctcgaactcaaaggaatgagctacgctatgtgcaccaacacatttgtactcaagaaagaagtctcggaaacacaacacggcacaatcttgatcaaagtcgaatacaaaggcgaagatgtaccgtgcaaaataccatttagcacggaagacggccagggcaaagcacacaacggccgattaatcacagccaacccagtagttaccaagaaggaagaacccgtcaacatagaagcggaacctccattcggtgagtcaaacatagtcatcggcatcggggacaacgccctcaaaatcaactggtacaagaaaggtagctcgataggcaaaatgttcgaggccacagccagaggcgcgaggagaatggcaatcctgggagatacagcctgggacttcggatcggtgggcggggtactaaactcgctcggaaaaatggtacaccaaatttttggaagcgcgtacacagcactcttctcaggggtgagctgggtcatgaaaataggcataggcgtactactaacctggataggactcaacagtaaaaacacaagcatgtccttctcctgcatcgcgatcggaataatcaccctatacctaggagcagtcgtgcaagcataa

SEQ ID NO: 2454 - RNA, 2037 nt, synthetic construct
  misc_feature 1..2037: note = derived and/or modified CDS sequence (opt11) from DENV-3 Consensus__SSopt-prME(S184F)
  source 1..2037: mol_type = other RNA
atgaaacgcaagaaaacaagtctgtgccttatgatgatcttacctgccgccctcgcctttcacctgacatcacgcgacggcgaacccaggatgatcgtaggcaaaaatgaaagaggaaagtccctcctcttcaaaactgcctcaggcataaatatgtgcacgctaatagccatggacctaggcgaaatgtgcgacgacaccgtaacctacaaatgcccccacatcacagaagtagaaccagaagatatcgactgctggtgcaacctaacaagcacttgggtaacctacggaacctgcaaccaagcaggcgaacaccgacgcgacaaacgcagcgtcgccctcgccccgcacgtaggaatgggactagacacacgaacacaaacgtggatgagtgccgaaggagcctggcgccaagtagaaaaagtcgaaacatgggcactcagacaccccggcttcaccatactcgccctcttcctggcccactatataggcacctcacttacccaaaaagtcgtgatattcatactactcatgctcgtcacacccagcatgacaatgagatgcgtaggagtcgggaaccgggacttcgttgagggcctgagcggcgccacatgggtggacgtagtcctcgagcacggtggctgtgtgacaacaatggccaaaaacaagcccacgctagacatagaactacagaaaaccgaagcaacccaactggccacactaaggaaactatgcatagaaggaaaaataaccaacatcacaaccgacagcagatgcccaacccaaggggaggccaccctcccagaagaacaagaccagaattacgtatgcaagcacacatacgtagaccgcggctggggaaatggttgcggactgttcggcaaagggagcctagttacctgcgcgaaattccaatgcctcgaacccatagaaggaaaagtggtccaatacgaaaacctaaaatacaccgtaatcataaccgtccacacgggggaccaacaccaagtaggcaacgaaacacagggagtaaccgccgaaataacaccacaagcctcaaccacagaagctatcctccccgaatacggcacactcggactagaatgcttcccccgcacaggcctagacttcaacgagatgatactcctaaccatgaaaaacaaagcctggatggtacaccgtcaatggttcttcgacctccccctcccgtggaccagcggggccacaaccgaaaccccaacatggaaccggaaagaactgctagtaacgttcaaaaacgctcacgctaaaaagcaagaggtagtggtcctaggatcacaagaaggggcgatgcataccgcactgacaggggcaaccgaaatacagaactcaggcggcacgtccatcttcgccggacacctaaaatgccgcctcaaaatggacaagctagagctcaaaggaatgtcctatgctatgtgcacaaacactttcgtactcaagaaagaagtcagcgagacgcaacacggaacgatcctaatcaaggtagaatataagggagaagacgtaccatgcaaaatccccttctccaccgaagacggccagggcaaggcacacaacggccgcctaatcaccgccaaccccgtggtgacaaagaaagaggaacccgtgaacatcgaagccgaacccccatttggggaaagcaacatcgtcatcgggatcggagacaacgccctaaaaatcaactggtacaagaaaggctcatcaatcggaaaaatgttcgaagccacagcaagaggcgcacgtcgaatggcaatcctaggcgacaccgcatgggacttcggatcagtgggcggcgtcctaaacagcctcggtaaaatggtccaccaaatcttcggaagcgcatacacggccctattcagcggggtaagctgggtaatgaaaatcggaatcggcgtactactgacatggataggactcaacagcaaaaacacatcaatgagcttcagctgcatcgcaataggaatcatcaccctctacctgggcgccgtagtccaagcataa

SEQ ID NO: 2455 - RNA, 2037 nt, synthetic construct
  misc_feature 1..2037: note = derived and/or modified CDS sequence (opt11) from DENV-3 Consensus__SSopt-prME(R186L)
  source 1..2037: mol_type = other RNA
atgaaacggaaaaaaacaagcctgtgcctcatgatgatcctgcccgctgcactagccttccacctaacatcacgagacggcgaaccaaggatgatcgtcggcaaaaacgagagaggaaaaagcctactgttcaaaacggcatcgggaatcaacatgtgcaccctgatagcaatggacctaggcgaaatgtgcgacgacaccgtcacctacaaatgcccccacatcacagaagtggaaccagaagacattgactgctggtgcaacctcacaagcacctgggtcacctacggaacctgcaaccaagcaggcgaacacagaagagacaaacggagtgtcgccctggccccgcacgtgggcatgggcctcgacacgagaactcaaacatggatgagcgcagaaggcgcctggcgccaggtagagaaagttgaaacctgggccctaagacacccaggcttcacaatactcgccctcttcctagcacactacatcgggacctcactaacacaaaaggtagtcatattcatactactaatgctcgtgacaccttcaatgaccatgcgctgtgtaggagtcggaaaccgagacttcgtagaaggcctcagcggagcgacgtgggtggacgtggtgctagaacacggcggctgcgtcaccacaatggcaaaaaacaaaccaacactcgacatcgaactccaaaaaacagaagcgacccaactagcaaccctccgaaaactctgcatcgaagggaaaatcacgaatatcaccacagacagcaggtgccctacacagggcgaagcaacgcttccggaagaacaagatcaaaactacgtctgcaaacatacctacgtagacaggggatggggtaacggatgcggcctcttcggaaaaggcagcctcgtcacatgcgcaaaattccaatgcctagagccaatcgaaggaaaagtggtgcagtacgaaaaccttaaatacacagtcatcataaccgtccacacgggcgaccaacaccaagtcggaaatgagacccagggagtcacagcagaaatcacaccccaagcctccaccacagaagcgatactcccagaatacggaaccctcggcctcgagtgcagcccactcacgggactggacttcaacgagatgatcttattaacgatgaaaaacaaagcatggatggtacaccgccaatggttcttcgatctaccactcccctggacatccggagccacgaccgaaacacccacctggaacagaaaagaactcttagtaacattcaaaaacgcacacgccaaaaagcaagaagtcgttgtccttggatcacaagaaggagctatgcataccgctctaactggcgcgaccgagatccagaactccggaggaacctcaatcttcgccggacacctcaagtgccgcctaaaaatggataaactcgaactgaaaggcatgagctacgccatgtgcaccaacacattcgtactgaaaaaagaagtcagcgaaacacaacacggcacaatcctcatcaaagtagaatacaaaggcgaagacgtaccctgcaaaatccccttctccacagaggacggacaaggaaaagcccacaatgggcgcctcataaccgccaaccctgtggtcaccaaaaaggaagaacccgtcaacatcgaagcagaaccacccttcggagagagcaacatcgtcataggaatcggagacaacgcattaaaaataaactggtacaaaaaaggatcatcaataggaaaaatgttcgaagccacagcacggggcgcacgccggatggcaatcctaggagataccgcctgggacttcggaagcgtcggcggggtcctgaactcactcggtaaaatggtccaccaaatattcggaagtgcctacaccgccctattctcaggcgtgagctgggtaatgaaaataggcataggcgtactcctaacatggataggactcaacagtaaaaacaccagcatgagcttcagctgcatcgccatcggaattataaccctatacttaggagcagtagtacaagcctaa

SEQ ID NO: 2456 - RNA, 2037 nt, synthetic construct
  misc_feature 1..2037: note = derived and/or modified CDS sequence (opt11) from DENV-3 Consensus__SSopt-prME(N240S)
  source 1..2037: mol_type = other RNA
atgaaacgaaagaaaacgtccctatgcctaatgatgatcctacccgcagccctggcctttcacctaaccagccgcgacggcgagccacggatgatcgtcgggaaaaacgaacggggcaaaagcctactcttcaaaaccgcctcgggcataaacatgtgcacacttatagccatggacctcggcgaaatgtgtgacgacaccgtaacatacaaatgcccacacattacagaagtcgagcccgaagacatcgactgctggtgcaacctcaccagcacatgggtaacctacggaacgtgcaaccaagcgggcgaacacagaagggataaaagaagcgtggccctagcaccgcacgtaggcatgggactagacacacgaacccaaacatggatgagcgcagaaggcgcctggcgccaagtagaaaaagtggaaacatgggcactcagacacccgggcttcaccatcctagccctattcctagcacactacatcggtaccagcctcacacagaaagtcgtaatattcatactcctcatgctggtcacacccagcatgaccatgagatgtgtcggggtcgggaaccgcgacttcgtcgaaggcctgagtggggcaacatgggtagacgtggtactagaacacggcggatgcgtaaccacgatggcgaaaaacaaacctaccctcgacatcgaactgcagaaaacagaggccacacaactcgccaccctcaggaaactgtgcatagaggggaagataacaaacatcacaaccgacagccgatgcccaacacaaggcgaagccacgctaccggaagaacaagaccaaaactacgtatgcaaacacacttacgtggacagaggctggggcaacggctgcggcttgttcggaaaaggaagcctagtaacatgcgccaaattccaatgcctcgagcccattgaaggaaaagtggtccaatacgagaacctcaaatatacagtaatcataaccgtgcacacgggagaccaacaccaagtgggaaacgagacacaaggagttacagccgaaatcacgccacaggccagcacaaccgaagcgatcctaccagagtacggcacattaggcctcgaatgctccccgagaacaggcctggacttcaacgaaatgatactcctcaccatgaaaaacaaagcatggatggtccaccgccaatggttcttcgacctaccgctaccgtggacatcaggggccacaaccgaaacaccaacatggaaccggaaggaacttctcgtaacgttcaagagcgcacacgcgaagaaacaagaggtcgtagtcctaggctcacaagagggagcaatgcacaccgccctcaccggagcgacagaaatccaaaactcaggaggtacgtcaatcttcgcagggcacctgaaatgccgcctgaaaatggacaaactcgaactaaaaggcatgtcctatgccatgtgcacaaacaccttcgtactcaaaaaggaagtatcagaaacgcagcacggcacgatactaatcaaggtagagtacaagggcgaagacgtaccctgcaaaataccattcagcaccgaagacggccagggcaaagcccacaacggacgattaatcacagcaaaccccgtggtaacaaagaaagaagaacccgtaaacatagaagcagaaccacctttcggagaaagcaacatcgtgatcgggataggagacaacgccctaaaaataaactggtacaagaaaggcagctcaatcgggaaaatgttcgaggcaacagcacgaggtgcgagacgcatggcgatactgggcgacaccgcatgggacttcggaagcgtgggcggagtcctaaactcactaggaaaaatggtacaccaaatcttcggctcggcatacacagccctattctcgggagtatcatgggtcatgaaaatagggatcggagtgctcctgacctggatcggcctaaattccaaaaacacatccatgtcattcagctgcatcgctatcgggataataaccctgtacctaggcgcagtcgtacaagcgtaa

SEQ ID NO: 2457 - RNA, 2037 nt, synthetic construct
  misc_feature 1..2037: note = derived and/or modified CDS sequence (opt11) from DENV-3 Consensus__SSopt-prME(M258L)
  source 1..2037: mol_type = other RNA
atgaaacgcaagaaaacaagcctgtgcctaatgatgatcctgcccgccgccctagcgttccacctcacctcacgagatggcgaacccagaatgatagtagggaaaaacgagaggggaaagagcctcctgttcaaaaccgcctcaggcatcaacatgtgcacgctgatcgccatggacctcggcgagatgtgtgacgacaccgtaacctacaaatgcccacacatcacagaagtcgaacccgaggacatagactgctggtgcaacctcacctctacgtgggtgacctacggaacatgcaaccaagcgggagaacatagacgcgacaaacgatcagttgccctagcgccccatgtaggaatgggcctcgacacacggacccaaacatggatgagcgcagaaggcgcatggagacaagtcgaaaaagtagagacgtgggcgttacggcacccaggatttaccatactcgccctcttcttagcgcactacatcggaacctcactcacacaaaaagtagtcatcttcattctacttatgctcgtgaccccatccatgacaatgcgctgcgtaggggtaggaaaccgcgacttcgtcgagggactgagcggagccacatgggtagacgtggtactagaacacggcggttgcgtgacaaccatggccaaaaacaaaccaacgctagatatcgagctacagaaaacagaagcaacacaactagcaacactcaggaaactgtgcatcgaagggaaaataacaaacatcaccacagacagccgttgcccaacccaaggcgaagccacgctaccagaggaacaagaccaaaactacgtgtgcaaacacacatacgtcgacaggggctggggcaacggatgcgggttattcggaaaaggatcactggtaacctgcgcgaagttccaatgcctagagcccatagaaggtaaggtcgtacaatacgaaaacctaaagtacaccgtaatcataacagtacacacgggcgaccaacaccaagtcggaaacgaaacacaaggagtcacagcggaaatcacgccccaggccagcaccacggaagcaatactccccgaatacggaacactgggcctagaatgcagcccacgcacaggtctcgacttcaacgagatgatacttctgaccatgaaaaacaaagcctggatggtccatagacagtggttcttcgacttaccactaccatggacaagcggagcaacaacagagaccccaacatggaacagaaaagaactattagtcacgttcaaaaacgcacacgcgaagaaacaagaagttgtagtactaggctcacaagagggagcactccacaccgcgctgaccggcgcgacggagatccagaactccggagggacctcaatattcgcaggacacctaaaatgccgcctgaaaatggacaaactagagctcaaaggcatgagctacgcaatgtgcacgaacaccttcgtactcaagaaagaggtctcagaaacgcaacacggaacaatcctaataaaagtcgagtacaaaggcgaggacgtaccctgtaaaatccccttcagcaccgaagacggccaaggcaaagctcataacggacggctcatcacagcaaaccccgtagtaacaaagaaagaagaacccgtgaacatagaagccgagccacccttcggagagagtaacatcgtaatcggaatcggagacaacgcactgaaaataaactggtacaagaaaggcagctcaatcggaaaaatgttcgaggcaaccgccaggggagcacgacggatggcaatcctcggcgacaccgcatgggacttcggctcagtaggaggagtcctaaacagcctcgggaaaatggtacaccaaatcttcggaagtgcgtacacagccctgttctcaggcgtaagttgggtaatgaaaatcggcataggcgtgttactgacttggatcggattaaacagcaaaaacaccagcatgagcttcagctgcatagcaattggcatcataaccctatacctaggcgccgtcgtgcaagcctaa

SEQ ID NO: 2458 - RNA, 2037 nt, synthetic construct
  misc_feature 1..2037: note = derived and/or modified CDS sequence (opt11) from DENV-3 Consensus__SSopt-prME(H259N)
  source 1..2037: mol_type = other RNA
atgaagcgcaagaaaacatccctatgcctcatgatgatcctaccagcagcactagccttccacctcaccagcagagacggcgagcccagaatgatagtggggaaaaacgaaaggggaaaatccctcctctttaaaacagcatcaggcataaacatgtgcaccctcatcgccatggacctaggcgaaatgtgcgatgacacggtgacctacaagtgcccccacattacagaagtcgagcccgaagacatcgactgctggtgcaatctaaccagcacgtgggtaacctacggcacatgcaatcaagcaggcgagcaccgacgagacaagcgaagcgtagcactcgccccacacgtcggaatgggcctcgacacccgcacacaaacctggatgagcgcagaaggtgcctggagacaggtcgaaaaagtggaaacgtgggcgctccgccacccaggcttcaccatcctcgccctatttcttgcacactacatcggaacatcactaacacaaaaggtcgtcatcttcatcctactgatgctggtcaccccaagcatgaccatgcgatgcgtaggggtaggtaaccgagactttgttgaaggcctaagcggggccacctgggtcgacgtagtgctggaacacggcggatgcgtaactacaatggccaaaaacaaaccaactctcgacatcgaactgcaaaagaccgaagcaacccaactagctacactccgcaaactatgcatagaaggaaaaataacaaacataacaaccgattcccgctgccccacccagggagaggccacactacccgaggaacaagaccaaaactacgtctgcaaacacacctacgtagacaggggctggggcaacggatgcggattattcggcaaaggaagcctcgtcacatgcgcgaagttccaatgcctcgaaccaatcgaagggaaagtagtccaatacgaaaacctaaaatacaccgtcatcataaccgtccacacgggcgaccaacaccaagtaggcaacgaaacgcaaggcgtcacagccgaaatcacaccccaagcctcaaccacggaagcaatcctccccgagtacggaacactcggcctagaatgcagcccgcgaacaggactcgacttcaacgaaatgatccttctaaccatgaaaaacaaagcatggatggtccaccgacagtggttcttcgacctcccactcccctggacaagcggagcaacaacagaaacccccacctggaacagaaaggaactactcgtcacattcaagaacgcgcacgcgaagaaacaagaagtcgtagtcctaggatcccaagagggcgcaatgaacaccgcactcacaggcgccacggaaatacaaaactcaggcggaacatccatattcgccggacacctaaaatgcagactaaaaatggacaaacttgagctcaaaggcatgtcctacgctatgtgcacaaacacattcgtgctcaagaaagaagtctcagagacgcaacacggaacaatcctaataaaagtcgaatacaaaggcgaagacgtcccatgcaaaatacccttcagcacagaggacggccagggaaaagcccacaatgggcgcctaatcacggctaaccccgtggtcaccaagaaagaagaacccgtaaacatagaagccgaaccacccttcggcgaatccaacatagtaatcggcatcggcgacaacgccctaaaaataaactggtacaagaaaggctcctcgataggaaaaatgttcgaagccacggccagaggagcgcgaagaatggcaatactaggcgatacagcatgggacttcgggagcgtaggcggggttctaaactcgctaggtaaaatggtacaccaaatcttcggaagcgcatacacagccctattcagcggcgtaagttgggtcatgaaaataggcataggagtactcctgacctggataggactaaacagcaaaaacacaagtatgagcttcagctgcatagcaatcggaatcatcaccctatacctaggcgccgtggtacaagcataa

SEQ ID NO: 2459 - RNA, 2037 nt, synthetic construct
  misc_feature 1..2037: note = derived and/or modified CDS sequence (opt11) from DENV-3 Consensus__SSopt-prME(H259R)
  source 1..2037: mol_type = other RNA
atgaagcgcaagaaaacaagcctgtgcctaatgatgatcctaccagcagccctggcgttccacctaaccagccgagacggcgaaccaaggatgatcgtagggaaaaacgaacgaggcaaaagcctactcttcaaaacagcatcaggcatcaacatgtgcaccctcatagccatggacctaggcgaaatgtgcgacgacacagtcacatataaatgcccccacatcacagaagtagaaccggaagatatagactgctggtgcaacctcaccagcacatgggtgacttacggaacctgcaaccaagcaggcgagcacagacgggacaaacgaagcgtagccctagcaccccatgtgggaatgggcctagacacacgcacacaaacatggatgagcgccgaaggcgcatggcgacaagtggagaaagtcgaaacatgggccctcaggcacccaggattcaccatcctggcactcttcctcgcccactacataggcacctccctcactcaaaaagtcgtaatattcatactgctgatgctagtgacaccctcgatgaccatgcgctgcgtgggcgtcgggaacagggacttcgtggaaggactatccggcgccacgtgggtagacgtagtactcgagcacggcggttgcgtcacaacaatggccaaaaacaaaccgaccctagacatagagttacagaaaaccgaagccacacaactggccacactaagaaaactgtgcatagaaggaaaaataaccaatatcacgaccgactccaggtgcccaactcaaggagaagcgaccctcccggaggagcaagaccaaaactacgtatgcaaacacacatacgtggatcgcgggtggggcaacggctgtggcctgttcggaaaagggagcctagtcacatgcgcgaaattccaatgcctcgaacccatcgaaggaaaagtagtacagtacgaaaacctgaagtacaccgtaatcatcaccgttcacacgggagatcagcaccaagtaggcaacgaaacacaaggcgtcacagcagaaatcaccccacaggcctcaacaacggaagcaatcctacccgagtacgggaccctaggcctagaatgcagtccacgaacaggactagacttcaacgaaatgatactgctaactatgaaaaacaaagcgtggatggtacatagacaatggttcttcgacctaccactaccgtggacctcaggcgcaaccacagaaaccccaacatggaacaggaaagaactcctggtcacattcaagaacgcgcacgcaaagaaacaagaagtagtggtcctaggttcacaagaaggagcgatgagaaccgcactcacaggagcgaccgaaatccaaaactcaggaggcacttccatcttcgccggccaccttaaatgccgactgaaaatggacaaactagaactaaaaggaatgagctacgccatgtgcaccaacaccttcgtactcaagaaagaggtttccgaaacacagcacggcacaatcctgataaaagtcgagtacaaaggcgaagacgtgccctgcaaaatcccattcagcacggaagacggccaaggcaaagcccacaacgggcgcctgatcacagccaacccagtggtcacgaaaaaggaggaacccgtaaacatagaagcagaaccgccattcggtgaaagcaacattgtaataggaataggggacaacgcgctgaaaatcaattggtacaagaaaggaagctccatcgggaaaatgttcgaagccacagccaggggagcacgccggatggcgatcttgggcgacacggcctgggactttggaagcgtaggaggagtcctgaacagcctagggaaaatggtccaccaaatattcggaagcgcatatacagctctgttctcaggcgtaagctgggtcatgaaaataggcatcggagtgctcttgacctggatcggcctcaacagcaaaaacacgagcatgagtttcagctgcatcgcaataggcatcatcaccctctacctaggcgcggtcgtgcaagcataa

SEQ ID NO: 2460 - RNA, 2037 nt, synthetic construct
  misc_feature 1..2037: note = derived and/or modified CDS sequence (opt11) from DENV-3 Consensus__SSopt-prME(A265T)
  source 1..2037: mol_type = other RNA
atgaaaagaaagaaaacctcactttgcctaatgatgatccttcccgcagccctagcattccacctaacctcacgcgacggcgagcccaggatgatagtcggcaaaaacgaacgaggcaagagcctactcttcaagacagcaagcggcataaacatgtgcacactaatagccatggacctgggagaaatgtgcgacgacaccgtcacatataaatgcccccatatcaccgaagtagaaccagaagatatcgactgctggtgcaacctcaccagtacatgggtaacctacgggacctgcaaccaggccggcgaacacaggagagacaaaagatcagtagccctggccccacacgtaggcatgggcctcgacacacgcacgcaaacatggatgagcgccgagggagcctggcgccaggtggagaaggtagaaacatgggctctgaggcacccaggattcacaatactagcactattcttagctcactacataggaacgagtctcacgcagaaagtcgtgatattcatactactcatgctcgtgacaccgtcaatgaccatgcgctgcgtcggcgtaggaaacagggacttcgtagagggcttaagcggcgcaacctgggtagacgtcgtgctagagcacggaggatgcgtgaccacgatggccaaaaataaacccaccctagatatagaactacagaaaacagaagcaacccaactagcaaccctaagaaaactatgtatcgagggaaaaataacaaacatcacgaccgacagcagatgccccacacaaggcgaagcaacactcccagaggaacaagaccaaaactacgtctgcaaacacacctacgtagacagaggctggggaaacggctgcggactgttcggaaaagggtcactcgtcacatgcgcaaaattccaatgcctcgagcctatcgagggcaaagtcgtacaatacgagaaccttaaatacacagtaatcataaccgtacacacaggcgaccaacaccaagtcgggaacgaaacccagggagtcacagccgaaatcaccccgcaggcatcaaccacagaagcgatcttacccgagtacgggaccctaggcctcgaatgcagcccgagaacaggactggacttcaacgaaatgatcctactaaccatgaagaacaaagcgtggatggtgcaccgacagtggttcttcgacctccccctcccgtggacaagcggagccaccaccgaaaccccaacctggaacagaaaagaactcctagtcacattcaaaaacgcacacgccaagaaacaagaagtagtagtactgggcagccaagaaggcgccatgcacacggccctcactggaacaaccgagatccagaacagcggcggaacctccatcttcgctggccacctaaaatgccgcttgaaaatggacaaactcgaactcaaggggatgagttacgccatgtgcacgaacacattcgttctcaagaaagaggtaagcgagacacaacacggaaccatactcataaaagtcgaatacaaaggcgaggacgtaccctgcaaaatcccattcagcacagaagatggccaaggcaaagcccacaacggacgactcataacggccaaccccgtcgtcaccaagaaggaagaaccagtaaacatcgaagcagaaccacccttcggcgagtcaaacatagttatcgggataggcgacaacgccctcaaaataaactggtacaagaaaggatctagcatcggcaaaatgttcgaagcaaccgccagaggcgcgcgccgcatggcgatactgggagacacagcctgggacttcggaagcgtgggcggcgtcctgaactcattaggaaaaatggtacaccaaatattcggaagcgcctacacagccttattcagcggcgtgagctgggtaatgaaaatcggcatcggcgtactactcacctggattgggctcaactcaaagaataccagcatgtccttcagctgcatcgccatcggaatcatcaccctatacctaggagccgtagtccaggcgtga

SEQ ID NO: 2461 - RNA, 2037 nt, synthetic construct
  misc_feature 1..2037: note = derived and/or modified CDS sequence (opt11) from DENV-3 Consensus__SSopt-prME(S296G)
  source 1..2037: mol_type = other RNA
atgaaacggaagaaaacgagcctatgcctgatgatgatcctgcccgcagcactagctttccacctgacatcccgggacggcgaaccaaggatgatcgtaggcaaaaacgaaagaggaaaaagcctcttgttcaaaacagcgagcggcatcaacatgtgcaccctcatagcaatggacctcggagaaatgtgcgacgacaccgtaacctacaaatgcccacacataacggaagtagagccggaagacatcgattgctggtgcaacctcacctccacgtgggtcacctatggaacgtgcaaccaagcaggcgaacaccgccgcgacaaacgaagcgtagccctagccccacacgtaggcatgggtttggatacacgcacgcaaacatggatgagcgccgagggcgcatggagacaagttgaaaaagtagagacctgggccctacgtcacccgggattcacaatcctcgcacttttcctagcccactatataggcacctcgctaacacaaaaagtagtaatattcatcctcctcatgctagtaacaccaagcatgacaatgcgatgcgtcggcgtaggaaacagagacttcgtcgagggactatctggggccacctgggtagacgtggtactagaacacggcgggtgcgtgaccacaatggcaaagaacaagccgactctagacatagaattgcagaaaaccgaagccacacaactagcaacactcagaaaactatgcatagagggtaaaataacaaatatcacaaccgatagcagatgccccacacagggagaagcaaccctcccggaggaacaagaccaaaactacgtatgcaaacacacctacgtggaccgaggctggggcaacgggtgcggtctattcggcaaaggaagcctggtcacgtgcgcaaaattccagtgcctagagccgatagaaggcaaagtagttcaatacgagaacctcaaatacacagtaatcataaccgtacacacgggcgaccaacaccaagtgggcaacgaaacacaaggagtcacggcagaaataacaccccaggcttctacaacagaagcaatcctccccgaatacgggacactaggcctagaatgcagcccgcgcacaggcctagacttcaacgagatgatcctcttaacaatgaaaaacaaagcctggatggtccaccgccaatggttcttcgacctaccactcccgtggacaagcggagccacaacagagacccccacctggaacagaaaagagctccttgtaacgttcaaaaacgcacacgcgaaaaagcaagaagtcgtagtcctaggctcacaagaaggcgcgatgcacaccgcactaacaggcgcaacggagatacagaactcgggcggaacctcgatcttcgccggacacctgaaatgccgcttaaaaatggacaaactcgagctaaaaggaatgggctacgcaatgtgcacgaacacattcgtactcaaaaaggaagtatcagaaacgcagcacggcaccatccttataaaagtcgaatacaaaggagaggacgtaccatgcaaaataccattctcaacagaagacggacagggcaaagctcacaacggacgcctaatcaccgccaatccagtagttacgaagaaagaggaacccgtgaacatagaagcagaaccaccattcggcgagtcaaacatcgtaataggaatcggagacaacgccctcaaaataaactggtacaaaaagggatcatctatcggaaaaatgttcgaagccacagccaggggcgcacgcagaatggcgatcctcggcgacacagcatgggacttcgggagcgtgggcggagtcctaaactcactcggcaaaatggtacaccaaatattcggcagcgcatacacagccctgttctccggggtgagctgggtcatgaaaataggcataggcgtactactgacctggataggcctcaacagcaaaaacaccagcatgagcttcagctgcatagcgattggaatcataaccctatatctgggcgcagtcgtccaagcgtga

SEQ ID NO: 2462 - RNA, 2037 nt, synthetic construct
  misc_feature 1..2037: note = derived and/or modified CDS sequence (opt11) from DENV-3 Consensus__SSopt-prME(S311R)
  source 1..2037: mol_type = other RNA
atgaagcgcaagaaaaccagtttatgcctgatgatgatcctacccgcggccctcgcattccacctaacctcgcgtgacggcgaacccagaatgatcgtcgggaaaaacgaaaggggaaaatccctcctgttcaagacagctagcggcataaacatgtgcacactcatcgccatggacttaggagaaatgtgcgacgacaccgtcacctataaatgcccccacatcacagaagtggaaccagaggacatcgactgctggtgcaacctcaccagtacgtgggtcacctatggaacgtgcaatcaagcaggcgagcacagacgagataaaagaagcgtagccctcgccccgcacgtaggcatgggactcgacacacgcacccaaacctggatgagcgcagaaggagcctggcgtcaggtagaaaaagtcgagacctgggcacttaggcatcccggcttcacaatactcgcacttttcctcgcccactatataggaacatccctcacacaaaaggtcgtgatcttcatcctgctcatgctcgtaaccccaagcatgactatgagatgcgtcggcgtcggaaacagagacttcgtcgagggactcagcggggccacctgggtggacgtagtactggaacatggcggatgcgtaaccaccatggcgaaaaacaaaccaaccctcgacatcgaactgcagaaaacagaagccacccaactcgcaacactaagaaaattatgcatcgaaggaaaaataacaaacatcacaaccgattcgaggtgcccaactcaaggtgaagcaaccctccccgaggaacaagaccaaaactacgtgtgcaaacacacatatgtcgacaggggatggggaaacggctgcggcctgttcgggaaagggagcctagtaacctgcgcaaaattccaatgcctagaacccatagaagggaaagtggtccagtacgagaacctgaaatacacagttataatcaccgtacacacaggagaccaacatcaagtgggaaacgaaacacaaggcgtaaccgccgagatcacgccccaagccagcacaacagaagcgatcctacccgaatacgggaccctcggcctggaatgcagcccccgcacgggactcgacttcaacgaaatgatactcctgacaatgaaaaacaaagcgtggatggtccaccgccaatggttcttcgacctaccgctcccatggaccagcggggccacgacagaaacaccgacctggaacaggaaggagctactcgtcacgttcaagaacgcacacgctaaaaagcaggaagtcgtcgtactggggagccaagaaggcgcaatgcacacagccctcacaggcgcgaccgagatccaaaacagcggcgggacgtcaatctttgccgggcacttaaagtgcagactaaaaatggacaagctagagctaaaaggaatgtcctacgccatgtgcacgaacacattcgtgctcaagaaagaggtcagagagacgcaacacggaaccatattgatcaaagtagaatacaaaggcgaggacgtcccctgcaaaatccccttcagtacggaagacggacaaggaaaagcccacaacggacgcttaatcacagcaaaccccgtagtaaccaagaaagaagaacccgtaaacatagaggcagaaccgcccttcggcgaaagcaacatagtcatcggaatcggcgacaacgccctcaaaatcaactggtacaagaaaggcagctccatcgggaaaatgttcgaagcaaccgccagaggagcgcgcagaatggcaatcctaggcgatacagcatgggacttcggaagcgtaggcggcgtcctcaactctctcggaaaaatggtccatcagatcttcggaagcgcgtacacagccctattctcgggcgtaagttgggtaatgaaaataggaataggcgtactattaacatggatcgggctaaacagcaaaaatacgtcaatgagcttcagttgcatagcgattggcataatcacattatacctaggtgccgtcgtacaagcctga

SEQ ID NO: 2463 - RNA, 2037 nt, synthetic construct
  misc_feature 1..2037: note = derived and/or modified CDS sequence (opt11) from DENV-3 Consensus__SSopt-prME(K321T)
  source 1..2037: mol_type = other RNA
atgaaaagaaagaaaacaagcctatgcttaatgatgatactccccgcggccttggcattccacctaacatcccgcgacggcgaacccaggatgatagtaggcaaaaacgaaagaggaaaaagcctgctatttaaaacggcaagcggcatcaacatgtgcaccctcatagccatggacttaggcgaaatgtgcgacgacacagtaacatataaatgtccccacatcaccgaggtcgaacccgaagacatcgattgctggtgtaacctcacgagcacgtgggtgacatacggcacatgcaaccaagcgggagagcaccgacgcgacaaacgaagtgtagccctagccccgcacgtcggcatgggactggacacgcgtacacaaacgtggatgagcgcagaaggagcgtggcggcaggtcgaaaaagtagagacatgggccctcaggcacccaggattcaccatactcgcgctattcctcgcccactacataggaaccagtctcactcaaaaagtcgtcatatttatcctactcatgctagtaaccccgagcatgaccatgcgatgcgtcggagtagggaacagagacttcgtggaaggcctgagcggagccacctgggtagacgtggtcctcgaacacggcgggtgcgtaaccacaatggcgaaaaacaaaccaactctggacatagaacttcaaaagaccgaagccacccaactggccacactccgaaaactgtgcattgaagggaaaataaccaacatcacaaccgacagcagatgcccaacccaaggagaagcaacactcccagaggaacaagaccaaaactacgtatgcaaacacacatacgtggaccgcggctggggaaacggatgcggcctattcggtaaaggctccctcgtaacgtgcgcaaaattccaatgcctagagccaatagaaggcaaagtcgtccaatatgaaaacctaaaatataccgtcatcatcaccgtacacaccggcgaccaacatcaagtaggaaacgaaacccaaggggtcacggccgagatcacaccacaagcctcaaccacagaagccatactaccagaatacggcacactgggactagaatgcagcccccgaacaggactagacttcaacgaaatgatactcctgacaatgaaaaataaagcatggatggtccaccgccaatggttcttcgacctacccctcccgtggacctccggtgcaaccaccgaaacaccgacctggaaccgcaaagagctcctcgtaacgttcaaaaacgcacatgcaaagaaacaagaagtcgtggtcctaggctctcaggaaggcgcgatgcacaccgcactaaccggcgcaacagagatccaaaactcaggcgggacatcaatcttcgccggccacctcaaatgccgccttaaaatggataaactcgaactcaaaggcatgagctatgcaatgtgcacaaacacattcgtactcaagaaagaagtctcagaaacacaacacggcacaatcctgatcacggtcgagtacaaaggcgaagacgtcccatgcaaaatcccattcagtacggaggacggacaaggcaaagcccacaacggccgcctaatcacagccaaccccgtggtcacgaagaaagaagaacccgtaaacattgaagcggaaccgccattcggcgaaagcaacatcgtaatcggaatcggcgacaacgcactgaaaataaactggtataagaaaggctcctcaatcggaaaaatgttcgaagccaccgcaagaggagcacgaaggatggctatcctcggcgataccgcttgggatttcgggtcagtcggcggagtactcaactcactcggaaaaatggtgcaccaaatattcggcagcgcatacaccgcactcttctcaggcgtgagctgggtcatgaaaataggcataggcgtactcctcacctggatcgggctcaacagcaagaacacgagcatgagtttctcctgcatcgcaatcggaatcatcactctctacctgggagcagtcgtgcaagcgtaa

SEQ ID NO: 2464 - RNA, 2037 nt, synthetic construct
  misc_feature 1..2037: note = derived and/or modified CDS sequence (opt11) from DENV-3 Consensus__SSopt-prME(G28C,H242C)
  source 1..2037: mol_type = other RNA
atgaaacgaaagaaaacgagcctctgcctgatgatgatactaccagccgccctagccttccacctcaccagccgagacggagaacccagaatgatcgtcggtaaaaacgagaggggaaaaagcctactctttaaaacagcctcaggcataaacatgtgcacactaatcgccatggacctaggagagatgtgcgatgacaccgtcacctataaatgcccccacatcacagaagtcgaaccggaagacatcgactgctggtgtaacctaacgagcacatgggtcacctacggcacatgcaaccaagccggcgaacaccgacgcgacaaacgcagcgtagccctagccccgcacgtaggcatgggactagacacccgcacgcaaacgtggatgagcgcagaaggagcctggcgacaagtcgagaaagtagaaacgtgggcactccgacacccgggcttcaccatactcgccctatttctcgcacactacatcggtacctccctaacacaaaaagtagtaatattcatcctactaatgcttgtaaccccaagcatgacaatgcgctgcgtcggagtaggtaaccgagacttcgtagaaggcctcagcggggccacgtgggtagacgtcgtcctggagcactgcgggtgcgtcaccacgatggccaagaataaaccgaccctagacatagaacttcaaaagacagaggcgacacaactcgccacactccggaaactatgcatagaaggaaaaatcaccaacataacgaccgacagccgatgcccgacacaaggcgaagccacactaccagaagaacaagaccaaaactatgtatgcaaacacacgtacgtcgacagaggctggggaaacggctgcggactattcggcaaagggtccctcgtcacgtgcgcaaagttccaatgtctcgaaccaatagaaggaaaagtggtccaatacgaaaatctcaaatacacagtgatcataaccgtccacaccggagaccaacaccaagtaggcaatgaaacacaaggagtcacagccgaaataacacctcaggcgtcaacaaccgaagcaattctacctgaatacggaaccctaggcctcgaatgcagtccacgcacaggactcgacttcaacgaaatgatactcctgacaatgaaaaacaaagcctggatggtacaccgccaatggttcttcgacctaccactcccgtggacaagtggcgccacaaccgagaccccaacctggaatcgcaaagagctcctagtcaccttcaaaaacgcatgcgcgaaaaagcaagaagtcgtcgtcctggggagccaagaaggcgcaatgcataccgcactaacaggcgcgaccgagatccaaaactcagggggaacaagcatctttgccggacacctaaaatgccgactcaaaatggacaaacttgaactcaaaggaatgagctatgccatgtgcacaaacacattcgtactaaagaaagaggtatcagaaacacaacacggcaccatcctaataaaagttgaatacaagggcgaagacgtcccctgcaaaatacccttcagcacagaagatggacaaggcaaggcccacaacgggcgactcatcacagcaaacccagtagtcactaagaaagaagaacccgtcaacatagaagccgaaccgcccttcggcgaaagcaacatagtcatcggaatcggagacaacgccctgaaaataaactggtacaagaaagggagcagtataggcaaaatgttcgaagcgacagccaggggtgcccgcagaatggcgatactgggcgacactgcatgggatttcggtagtgtgggcggggtcctgaactcactagggaaaatggtacaccaaatattcggcagtgcatacacggccctgttctcaggcgtcagctgggtcatgaaaattggcataggcgtactcctcacctggatcggacttaacagcaaaaacacaagcatgagtttcagctgcatagcaatcgggatcataaccctgtacctgggcgctgtcgtccaagcataa

SEQ ID NO: 2465 - RNA, 2037 nt, synthetic construct
  misc_feature 1..2037: note = derived and/or modified CDS sequence (opt11) from DENV-3 Consensus__SSopt-prME(R186L,A265T)
  source 1..2037: mol_type = other RNA
atgaaacgcaagaaaacgagcctgtgcctgatgatgatcctacccgccgccctggccttccacctaacctccagagacggcgaaccccgaatgatagtaggcaaaaacgaacgaggaaaaagcctcctattcaaaacggcatcaggaataaacatgtgcacgctcatcgccatggatctcggcgaaatgtgtgacgacaccgtcacctacaaatgcccccacatcacagaagtcgaaccagaagacatcgactgttggtgcaacctaacgagcacatgggtcacctacggcacgtgcaaccaagcaggcgaacaccggcgagacaaaaggtcagtcgccctcgcgccccacgtcggaatgggccttgacacgcgcacacaaacctggatgtcagcggagggagcctggaggcaagtcgaaaaagtcgaaacatgggcactcaggcacccaggcttcaccatacttgccctcttcctcgcccactacatcggcacctcactcacccaaaaggtagtaatcttcatcttgctaatgctcgtgacaccgagcatgacaatgcgatgcgtaggggtcggaaacagagacttcgtcgagggcctatcaggagccacctgggtagacgtagtcctggagcacggaggatgcgtaacaacaatggccaaaaacaaacccaccctggacatagaactccaaaagaccgaagcaacacaactagcaacgctaagaaaactctgcatcgaagggaaaatcaccaacattacaacagacagccgatgccccactcagggcgaagccacactaccggaagaacaagaccaaaactacgtatgtaaacacacctacgtggacagaggatgggggaacgggtgcggcttgttcggcaaaggatctctagttacgtgcgcaaaattccaatgcctcgagcccatagaaggcaaagtggtccaatacgagaacctaaaatacacagtaatcataaccgtccacacgggagaccaacaccaagtaggaaacgagacacaaggcgtaaccgccgaaatcacaccccaggcctccacaacagaggcaatactccccgaatacggaaccctgggactcgaatgctcaccactcaccggactagacttcaacgaaatgatacttctgacgatgaaaaacaaagcatggatggtacacagacagtggttcttcgacctacctttaccatggaccagcggagcaacaaccgaaaccccaacctggaaccgcaaagaactcctagtcaccttcaagaacgcgcacgcaaagaaacaggaggtcgtagtcctaggcagccaagaaggtgccatgcacaccgccctaaccggcaccacagaaatccaaaacagcggcggcacctccatatttgccgggcacctcaaatgcagactgaaaatggacaaactagagctcaaaggcatgtcctacgccatgtgcacaaacaccttcgtcctaaagaaagaggtatccgaaacccaacacggcacaatactgatcaaagtagaatacaaaggagaagacgtgccctgcaaaataccattctccacagaagacggccaaggaaaagcccacaacggaagactaataacagccaacccagtcgtaacaaagaaagaggaaccagtgaacatcgaggcagaaccacccttcggcgaaagcaacatcgtaataggaatcggcgacaacgctctcaaaataaactggtataagaaaggcagctcaatcggaaaaatgttcgaggccacggcacgaggcgcacgccgaatggcaatcctaggcgacacagcatgggacttcggcagcgtaggcggcgtactcaacagtctaggaaaaatggtccaccaaatattcggaagcgcctacacggccctattctccggagtgagttgggtcatgaaaataggcatcggagtacttctgacatggatcggcctcaacagcaaaaacaccagcatgtccttcagctgcatcgcgatcgggataataaccctatacctaggagcggtggtacaagcataa

SEQ ID NO: 2466 - RNA, 2037 nt, synthetic construct
  misc_feature 1..2037: note = derived and/or modified CDS sequence (opt11) from DENV-3 Consensus__SSopt-pr(D104A)ME(F108S)
  source 1..2037: mol_type = other RNA
atgaagcggaagaaaacgagcctgtgcctcatgatgatactgcccgcggccctagcatttcacctaacctcgagagacggcgaacccaggatgatagtagggaaaaacgaaaggggcaaaagcctgctattcaaaacggcatcgggcatcaacatgtgcacactcatagccatggacctaggggagatgtgcgacgacaccgtgacctacaaatgtccccacatcaccgaagtcgaaccggaagacatcgactgctggtgcaacctcaccagtacatgggtgacctacggcacatgcaaccaagcaggcgagcacaggagagcaaaaaggagcgtcgccctggcaccacacgtaggaatgggactcgacacgcgaacacaaacatggatgagcgcagaaggagcctggcgccaggtcgagaaagtggaaacgtgggcgctcaggcacccgggcttcaccatccttgccctcttcctcgctcactacatcggcacatcgctaacacaaaaagtcgtgatattcatactactaatgctcgtgaccccgagcatgaccatgcgatgcgtcggggtagggaaccgagatttcgtcgaaggattaagcggagccacatgggtggacgtcgtcctggaacatggcgggtgcgtcaccacgatggccaaaaacaaaccgaccctggacatagaactgcagaaaactgaggccacgcaactagccacgctgcgaaagctgtgcatagaagggaaaataaccaacatcacaaccgacagtaggtgcccaacgcaaggcgaagctacactaccagaagaacaagaccaaaactacgtatgtaaacacacatacgtggaccggggatggggcaacggttgtggactaagcggcaaaggaagcctggtcacgtgcgcaaaattccaatgccttgagccaatagaaggaaaagtggtccaatacgagaacttaaaatacaccgtaatcataaccgtacatacgggagaccaacaccaagtaggaaacgaaacacaaggagtgacagcagaaatcacaccacaggccagcacaacggaagccatactacccgagtacgggaccctggggctggaatgcagcccgcgcacgggattggacttcaacgaaatgattctcctgactatgaaaaacaaagcatggatggttcatcgccagtggttcttcgacctcccgctcccgtggacaagcggggccacgacagaaaccccaacctggaaccggaaagagctcctagtcacattcaaaaacgcacacgcgaaaaagcaagaagtcgtagtactgggatcgcaagagggagcaatgcacacggcactcacgggtgcaacagagatccaaaactcgggcggcaccagcatattcgcaggacacctgaaatgccgcctaaaaatggacaagctagagctaaaaggcatgagctacgccatgtgtacgaacacattcgtacttaagaaagaagtctcggaaactcaacacggcacaatcctcataaaagtcgaatacaagggagaagacgtcccatgcaaaataccgttctccacagaagacggccaaggcaaagcccataacgggcgactgatcacggccaaccccgtagtcaccaaaaaggaggagcccgtcaacatagaagcggaaccgcccttcggagagagcaatatcgtaatagggatcggagacaacgccttaaaaataaactggtacaagaaagggagctcaataggcaaaatgttcgaagccacagccaggggcgcgcgcagaatggcgatcctcggcgacacagcatgggacttcggatccgtaggaggggtcctaaactcgctaggaaaaatggttcaccaaatcttcggaagcgcttacacggcactgttcagcggagtgagctgggtcatgaaaataggcatcggagtgctcctgacatggatcggactcaacagtaagaacacgagcatgagttttagctgtatagcgatcgggatcataaccttataccttggagcggttgtgcaagcatga

SEQ ID NO: 2467 - RNA, 2037 nt, synthetic construct
  misc_feature 1..2037: note = derived and/or modified CDS sequence (opt11) from DENV-3 Consensus__SSopt-pr(D104A)ME(R186L,A265T)
  source 1..2037: mol_type = other RNA
atgaaacgcaagaaaacaagcctgtgtctaatgatgatactgccagccgccctcgcctttcacctcacgtcacgcgacggagaaccccggatgatagtcggcaaaaacgagcgaggaaaaagcctgctgttcaaaaccgcctccggtataaacatgtgcaccctcatagccatggacctaggcgaaatgtgcgacgacaccgtaacctacaaatgcccccacataacagaggtagaaccggaagacatagactgctggtgcaacctcacaagcacatgggtgacatacggcacatgcaaccaagcgggagagcaccggcgcgcaaaaagaagcgtcgccctcgcaccgcacgtgggcatgggccttgacacgcgtacccaaacatggatgtccgcagaaggagcctggcgccaagtagaaaaagtcgaaacctgggccctcagacacccaggcttcacaatactcgcattattcctcgcacactatataggaacaagtctaactcaaaaagtcgtgatattcatcctcctcatgctcgtaacgccgagcatgaccatgcgctgcgtcggagtaggaaaccgagacttcgtcgagggactaagcggagcaacatgggtagacgtggtactagaacacggaggatgcgtgaccaccatggccaaaaacaagcccacgctcgacatagaactacagaaaaccgaagcaacccagctggccacgctacgaaaactatgcattgaaggaaaaatcactaacatcacaaccgactcacgctgccccacccagggcgaagcgaccctccccgaggaacaagaccaaaactatgtatgcaaacacacctacgtagaccgaggctggggcaacggctgcggcctcttcggaaaggggtccctagtaacctgcgccaaattccagtgcctcgaaccaatagaaggaaaagtagtccaatacgaaaacctaaagtacaccgtgatcatcacagtacacacgggcgaccagcaccaagtcggaaatgaaacacaaggagttaccgcggaaataacaccacaggcatccacaacagaagccatcctacccgaatacggaacactgggcctagagtgtagcccactaaccggcctcgacttcaacgaaatgatactcctcaccatgaaaaacaaagcctggatggtccatcgccaatggttcttcgacctcccgctaccatggacatcaggagcaacaaccgaaaccccaacctggaaccgcaaagagctcctagtaacgttcaaaaacgcgcacgcaaagaaacaagaggtcgtggtcctgggaagccaagaaggcgccatgcacaccgctctcacaggcacgaccgaaatccagaacagcggcggaacctccatcttcgcaggacacttaaaatgccgcctcaaaatggacaaactcgaactaaaaggcatgagctacgccatgtgcacaaacacattcgtgttaaagaaagaagtaagcgaaacccaacacggaactatcttgattaaagtggaatacaaaggagaagacgtaccctgcaaaatccctttcagcacagaagacggacaaggcaaagcccacaacggacgcctaattacagcaaacccagtggtcacaaagaaagaggaaccggtaaacatagaagcagaaccgccattcggcgagagcaacatcgtaatcgggatcggagacaacgcactcaaaataaactggtacaagaaagggtcatccatcggaaaaatgtttgaagcaacagcgagaggcgcacgccgaatggcaatcctgggcgacacagcatgggacttcggaagcgtgggcggcgtcctgaactccctcgggaaaatggtacaccaaatattcggaagcgcgtacacagccctattctccggcgtcagctgggtcatgaaaatcggcataggcgtcctactaacctggataggactaaacagcaaaaacaccagtatgagtttcagctgcatcgcgatcggaatcatcaccctatacctcggcgccgtagtccaagcgtaa

SEQ ID NO: 2468 - RNA, 2037 nt, synthetic construct
  misc_feature 1..2037: note = derived and/or modified CDS sequence (opt11) from DENV-3 Consensus__SSopt-pr(D104A)ME(F108S,R186L,A265T)
  source 1..2037: mol_type = other RNA
atgaaacgcaagaaaacgagcctatgcctgatgatgatcctacccgcagcactagccttccacctgacaagccgcgacggcgaaccgcgcatgatcgtggggaaaaacgaacgaggaaaaagcctactgttcaaaacagctagcggcatcaacatgtgcacccttattgcaatggatttaggagagatgtgcgacgacacagtgacctacaaatgcccccacatcaccgaagtggagccagaagatatcgactgctggtgcaacctaacatcaacatgggtaacctacggaacttgcaaccaagccggtgaacaccgccgggccaaaagaagcgtcgcactggccccacacgtcggcatgggcctagacactcggacacaaacgtggatgtcggcggaaggcgcctggcgacaagtcgaaaaagtagaaacctgggcgctcagacatccaggcttcacgatactagccctcttcctcgcgcactacataggaacaagccttacccaaaaagtagtaatattcatactcctcatgctcgtcaccccaagcatgaccatgcgctgcgtaggcgtcggtaaccgagacttcgtagaaggactatcgggagccacctgggtggacgtggtactagaacatggaggctgcgtcacaaccatggctaaaaacaaaccaaccctagacatcgaactacagaaaaccgaagcaacacaactcgcaaccctcaggaaactctgcatcgaaggtaagatcaccaacatcacgaccgacagccgctgcccaactcaaggcgaagcgacactaccggaagaacaagatcagaactacgtatgcaaacacacatacgtcgacagaggatggggcaatggctgcggactaagcggaaaaggcagcctagtaacctgcgcaaaattccaatgcctcgaacccatcgaaggtaaggtcgtacaatacgaaaacctcaaatacacagtaatcatcacagtccacaccggcgaccaacaccaggttggcaacgagacacaaggagtgacggccgaaatcacaccccaagcatcaaccaccgaagcgatcctccccgaatacggaaccctgggcctcgaatgcagccccctcacaggcctcgacttcaacgaaatgattctactcacaatgaaaaacaaagcctggatggtgcaccgccaatggttcttcgacctgcccctaccctggaccagcggagccacgacagaaacaccaacctggaaccgcaaagagctcctcgtcacattcaaaaacgcccatgccaagaaacaagaagtagtcgtcctaggatcacaagaaggcgcaatgcacaccgccctcacaggaaccaccgagatccaaaacagtggcggaacctccatattcgcgggacacctcaaatgtcgcctgaaaatggacaaactggagctaaaaggaatgtcctacgccatgtgcaccaacacattcgtactaaagaaagaagtctcagaaacccaacacggaacaatactcatcaaagtcgaatacaaaggagaggacgtcccgtgtaaaatcccattcagcacagaagatggccaaggaaaagcccacaacgggagactaatcacagccaatcccgtcgtcaccaagaaagaggaaccagtcaatatcgaagcggaacccccgttcggcgaaagcaacatagtaataggcatcggagacaacgcactcaaaatcaactggtacaagaaagggagctcgataggcaaaatgttcgaagccacagcaaggggcgcgcgaagaatggccatcctcggcgacacagcatgggacttcggcagcgtaggcggagtcctaaactctctaggcaaaatggtccaccaaatcttcggcagcgcatacaccgccctgttctccggcgtgtcatgggtaatgaaaataggcataggagtcctactgacatggatcggactcaacagcaaaaacacgtcaatgtccttctcctgcatcgcaatagggatcataaccctatacctcggagcagtagtccaagcctga

SEQ ID NO: 2469 - RNA, 2016 nt, synthetic construct
  misc_feature 1..2016: note = derived and/or modified CDS sequence (opt11) from DENV-3 Consensus__SSopt-prMEdel101-107,(R99P,F108N)
  source 1..2016: mol_type = other RNA
atgaaacgcaagaaaacatctctctgcctcatgatgatcctccccgcagctctcgcgttccacctcacaagcagagacggggagccccgcatgatagtaggcaaaaacgaacgcggcaaatcactccttttcaaaacagcctcaggaataaacatgtgcacactcatagccatggacctcggcgaaatgtgcgacgacacagtcacgtacaaatgcccgcacatcacagaagtagaaccagaagacatagactgctggtgcaacctaacatctacatgggtcacctacggaacctgcaaccaagccggcgagcaccgaagagacaaacgctcagtcgccctcgccccacacgtgggaatgggactagacacaagaacccaaacctggatgtcagcagaaggcgcgtggcggcaagtcgagaaagtcgaaacctgggccctacgccacccaggcttcactatccttgccctcttcctcgcacactacataggcacctccctaacacagaaagtagtaatcttcatactactaatgctagtcacgccctcaatgacaatgcgctgcgtcggcgtaggaaaccgagatttcgtagaaggactatcaggagcaacgtgggtcgacgtagttctagaacacggcggctgcgtcacgacaatggccaaaaacaaacccacacttgacatcgaactccagaaaacagaagcaacccaactagcaaccttgcgcaagctctgcatcgaaggaaaaatcacaaacatcaccacagattcacgctgcccaacgcaaggcgaagcaaccctacccgaagaacaagaccaaaactacgtctgcaaacacacatacgtcgacccgggcaacgggaaaggaagtctagtgacctgcgcaaaattccaatgcctcgagccaatcgaagggaaagtcgtccaatacgaaaacctaaaatacaccgtcataatcacagtccacacgggcgaccaacaccaagtaggaaacgaaactcaaggcgtcaccgcagaaatcaccccacaagcctccacgacagaagcgatcctccccgaatacggcacactcggccttgagtgctcaccccgaacaggactagacttcaacgagatgatactactaacgatgaaaaataaagcatggatggtccacaggcaatggttcttcgacctcccgctcccctggacctcgggggccacaacagaaacaccaacttggaaccgaaaagaactcctcgtgaccttcaagaacgcacacgcaaagaaacaagaagtcgtcgtcctaggctcacaggagggcgctatgcacacagccctcacaggggccacagagattcaaaactccggcggcacctccatcttcgccggacacctaaaatgccgacttaaaatggacaaactggaactcaaaggcatgtcatacgccatgtgcacaaataccttcgtcctaaagaaagaagtcagcgaaacgcaacacggcaccatcctaataaaagtagagtacaaaggagaagacgtcccatgcaaaatccccttcagcaccgaagacggccaaggcaaagcacacaacggacgactaataaccgccaaccccgtagtaacaaagaaagaagaacccgtcaacatagaggcagaacctcccttcggcgaaagcaacatagtaatcggcataggcgacaacgcactgaaaatcaactggtacaagaaagggagttccatcgggaaaatgttcgaagccacagcccgcggagcacgacgcatggccatcctaggagacacagcctgggacttcgggtccgtgggaggtgtcctcaactcactaggaaaaatggtccaccaaatattcggatccgcctacacagcactattctctggcgtctcatgggtcatgaagattggaatcggcgtcctcctgacctggataggacttaacagtaagaacacgagcatgagcttcagctgcatagcaatcggcatcatcacgctctacctaggcgccgtagtacaggcctaa

SEQ ID NO: 2470 - RNA, 2037 nt, synthetic construct
  misc_feature 1..2037: note = derived and/or modified CDS sequence (opt11) from DENV-3 Consensus__SSopt-prMEdelstem_TM-JEV
  source 1..2037: mol_type = other RNA
atgaagcgcaagaagacatccctctgtctgatgatgatcctacctgcagcactagcattccacctgacaagcagagatggcgaacccagaatgatagtaggaaagaacgaaagaggcaaaagtctcctattcaaaactgcctccggaatcaacatgtgcacgctaatagccatggacctaggagaaatgtgcgacgacaccgtaacctacaaatgcccccacatcacggaggtggaaccagaagacatcgactgttggtgcaacctaacaagcacgtgggtcacctatggcacatgcaaccaagcaggcgagcaccggcgagataaacggagcgtggctctggccccacacgtcggaatgggcttagacacccgaacgcaaacatggatgtcagcggaaggagcctggagacaagtcgaaaaagtggaaacatgggcactcaggcacccgggcttcacaatcctcgcactcttcctcgcgcactacatcggaaccagtctaacacaaaaagtcgtaatattcatcctacttatgctagtgacaccaagcatgacaatgagatgcgtgggcgtcggaaacagagacttcgtcgagggcctaagcggggccacttgggtggacgtggtcctagaacacggcggatgcgtaacaaccatggcgaaaaacaagccaaccctagacatagagctacagaaaaccgaagccacacaactggccacactcagaaaactatgcatcgaaggaaaaattacaaacatcacaaccgacagcagatgccccacccaaggcgaagccacactcccggaggaacaagatcaaaactacgtgtgcaagcacacctacgtggaccggggctggggcaacggctgcggactattcgggaaagggagcttggtaacgtgcgcaaaatttcaatgcctcgagcccatagaaggcaaagtcgtacagtatgagaacttaaaatacaccgtcataatcaccgtacacacgggagaccaacaccaagtaggcaacgaaacacaaggggtcacggccgaaatcacgccccaggccagcaccacagaagcaatcctcccagaatacggcacactcggactagaatgcagcccgcgcacaggcctagacttcaacgaaatgatactcctaacaatgaaaaacaaagcgtggatggtccaccgtcaatggtttttcgacctacccctaccgtggacaagcggagcgacaaccgaaacccccacatggaacagaaaagagctgctagtcacgttcaaaaacgcacacgcgaaaaagcaagaagtagtggtcctaggctcacaagagggcgcaatgcacaccgcactaaccggggcgaccgaaatacaaaactcgggaggaacctccatcttcgccggccacctgaagtgtcgactcaaaatggataaactcgagctgaaaggcatgtcctacgccatgtgcaccaacacattcgtactcaagaaagaagtcagcgaaacccaacacggcacaatactaatcaaagtcgaatacaaaggcgaagacgtcccctgcaaaataccattcagcacagaagacggccagggtaaagcccacaacggacggctcatcacggccaaccccgtagttacgaagaaagaggaacccgtaaacatagaagcagaaccgccattcggcgagagcaacatcgtcatcggaataggagacaacgcactaaaaataaactggtataagaaagggtccacactaggaaaagcgttcagcaccacactaaaaggagctcaaaggcttgcagccctgggcgacaccgcatgggacttcggcagcataggaggggtcttcaactccatcgggcgcgcagtacaccaagtattcggtggcgcattcagaactctattcggaggtatgagctggatcacgcaaggcctaatgggcgcactcctactctggatgggggtcaacgcccgggacaggagcatagctctcgccttcctcgcgactggaggcgtactcgtcttcttagccacgaacgtgcacgcataa

SEQ ID NO: 2471 - RNA, 2037 nt, synthetic construct
  misc_feature 1..2037: note = derived and/or modified CDS sequence (opt11) from DENV-3 Consensus__SSopt-pr(D104A)MEdelstem_TM,(F108S)-JEV
  source 1..2037: mol_type = other RNA
atgaaacgaaagaaaacaagcctatgcctcatgatgatcctccccgcggcccttgcattccacctaacctcgcgcgacggagagcccaggatgatagtaggcaaaaacgaaagaggcaaaagcctactattcaaaaccgcctcaggcatcaacatgtgcacactgatagccatggacctaggagaaatgtgcgatgacacagtaacatacaaatgcccccacataacagaagtcgaaccagaagatatcgactgttggtgcaacctcacaagcacatgggtaacctacggaacctgcaaccaagccggcgaacaccgacgtgccaaacgcagcgtcgccctagcaccacacgtaggcatgggcctcgacacacgcacacaaacatggatgagcgcagagggggcgtggagacaagtcgaaaaagtagaaacatgggccctcagacacccgggcttcacaatcctagcgctattcctggcgcactatatagggacctcgctcacccagaaggtcgtcatcttcatcctactcatgctggtcaccccctccatgaccatgcgctgcgtgggagtcgggaacagagacttcgtggaagggttaagcggggccacatgggtcgacgtagtcctggagcacggagggtgcgtaacgaccatggccaaaaacaaacccaccctagacatcgaactacagaaaaccgaagcaacccaactggcaacactccgaaaactatgcatcgaaggtaaaatcaccaacataaccacggatagccgatgcccaactcagggcgaggcaacacttcccgaggaacaagaccaaaactacgtatgcaaacacacctacgtagacagaggatggggcaacggctgcggactgagcggaaagggatccctggtaacatgcgccaaattccaatgccttgaacccatagaaggaaaggtcgtccagtacgaaaacctcaaatataccgtaatcataacagtccacacaggagaccaacaccaagtcggcaatgaaacgcaaggagtcacggcagaaatcacaccccaagcctccaccacggaagcaatactccccgagtacggtacactgggcctcgagtgcagcccacgcaccggcctagacttcaacgagatgatcctcctgaccatgaaaaacaaagcgtggatggtccatcggcaatggttcttcgacttaccactcccgtggacctcaggggccaccaccgagacccccacctggaaccggaaagagctcctagtcacattcaaaaacgcccacgcaaagaaacaagaagtcgtggtactaggctcccaagaaggggcaatgcacaccgcattaacaggcgcaaccgaaatccaaaactcgggagggacctcgatattcgcaggccacctcaaatgccgtctcaaaatggacaagctagaactaaaaggcatgagctacgccatgtgcacaaacacattcgtactaaagaaagaagtcagcgagacacaacacggcacaatcctcataaaagtagagtataaaggcgaagacgtaccctgcaaaataccattcagcacagaggacggccaaggaaaggcccacaatgggcgcctcataacagctaacccagtagtaacgaagaaagaggagcccgtcaacatcgaagcagaaccacccttcggcgaaagcaacatcgtcatcggaatcggagacaacgccctaaaaatcaactggtacaagaaagggagtacacttggcaaagcattctcgacaacacttaagggcgcacaaagactcgcagcactgggagacacagcatgggacttcggcagcatcggcggcgtcttcaactccataggaagggctgtccaccaagtattcggcggcgccttccgcacgctattcggaggaatgagctggatcacgcaaggactaatgggagcactcctcctatggatgggagtaaacgcgagagacagatccatagccctagccttcctagcgaccggaggcgtactcgtattcttagcaaccaacgtccacgcataa

SEQ ID NO: 2472 - RNA, 2037 nt, synthetic construct
  misc_feature 1..2037: note = derived and/or modified CDS sequence (opt11) from DENV-3 Consensus__SSopt-pr(D104A)MEdelstem_TM,(R186L,A265T)-JEV
  source 1..2037: mol_type = other RNA
atgaaacgcaagaaaacgtccctatgcctaatgatgatcttacctgcagccctagcattccatctcacatcacgcgacggcgagccccgaatgatcgtcggcaaaaacgaaagaggaaaaagcctcctcttcaaaacagcctccggaataaacatgtgcacactcatcgccatggacctcggtgagatgtgcgacgacaccgtaacctacaaatgcccccatatcacagaagtcgaaccggaagatatcgactgctggtgcaacctcaccagtacctgggtgacatacggaacctgcaaccaagctggagaacacagacgagcgaaacgaagcgtggcccttgccccacacgtgggcatgggtctagacacacgaacgcaaacctggatgagcgcggaaggagcatggcgccaggtcgagaaagtcgagacatgggcactccgacaccctggcttcactatactagcactatttctcgcacactacatcggaacctcactaacacaaaaagtcgtaatcttcatcctactcatgctcgtaacccccagcatgaccatgcgctgcgttggagtcggaaacagggactttgttgaaggactcagcggagcaacgtgggtagacgtggtattagaacacggcggatgcgttaccacaatggcgaaaaacaaaccgacactagacatagagctgcagaaaaccgaagccacacaactcgcaaccctacgaaaactatgcatcgaagggaaaatcacaaacatcaccacagactccaggtgccctacacaaggcgaagcaaccctcccagaggaacaagaccaaaactacgtatgcaaacacacatacgtggaccggggctggggaaacggttgcggcctcttcggaaaaggaagcctggtcacatgcgccaagttccaatgcctagaacccatagaagggaaagtagtccaatacgaaaacttgaaatacacagtcataattacagtacacacaggcgaccagcaccaagtcggcaacgaaacccaaggagtcacagccgaaatcacaccccaggcatccaccacagaagcgatactacccgaatacggaaccttaggactagaatgcagcccactcaccggcctagacttcaacgagatgatactcctaaccatgaaaaataaagcatggatggttcatcgccaatggttcttcgacctacccctcccatggacgagtggggcaactaccgaaacgccgacttggaaccgaaaagagctactggtcacattcaagaacgctcacgccaaaaagcaagaagtggttgtactgggctcgcaagaaggcgcaatgcacacagccctgacgggcaccaccgagatacagaactcaggcggaacctccatattcgccggccacctcaagtgccgattgaaaatggacaagctcgaactaaaaggcatgagttacgccatgtgcacaaacacgttcgtgcttaagaaagaggtctccgaaacacagcacggcacaatcctaatcaaagtcgagtacaaaggcgaggacgttccctgcaaaatacccttcagcacagaagatggccagggcaaagcccacaacggccgactaatcaccgccaaccccgtagtaaccaaaaaggaagaacccgttaacattgaagcagaaccaccattcggcgaatccaacatagtaatcggcataggagacaacgccctcaaaatcaactggtacaagaaaggatcaacgctcgggaaagccttctcgaccactctcaaaggcgcccaacgcctagcggcactaggcgacacagcctgggacttcggctccattggcggggtctttaactctataggacgcgcggtccatcaagtgttcggcggagcattcaggacactattcgggggcatgagctggatcacacaaggcctcatgggtgccctcctgctctggatgggagttaacgccagagaccgcagcatcgcactcgctttcctcgccaccggcggcgtactcgtcttcctcgccacaaatgtacacgcgtaa

SEQ ID NO: 2473 - RNA, 2037 nt, synthetic construct
  misc_feature 1..2037: note = derived and/or modified CDS sequence (opt11) from DENV-3 Consensus__SSopt-pr(D104A)MEdelstem_TM,(F108S,R186L,A265T)- JEV
  source 1..2037: mol_type = other RNA
atgaaacgcaaaaagacgagcctgtgcctaatgatgatcctccccgcagcccttgccttccacctgacatcccgcgacggagaacccagaatgatagtcgggaaaaatgaaagaggcaagtccctactcttcaaaaccgcatcagggataaacatgtgcacgctcatcgccatggacctgggagaaatgtgcgacgacacagtaacctacaaatgcccccacatcacagaagtggaaccagaagacatagactgctggtgcaatctgacatccacctgggtcacctacggaacgtgcaaccaggcaggcgaacacagacgcgcaaaacggtccgtcgcattggcaccccacgtaggaatgggcctggacacgcgaacacaaacttggatgagcgcggagggagcctggagacaggtcgagaaagtcgaaacatgggcacttagacacccaggcttcaccatactcgcactattcctcgcccactatatagggaccagcctcacacaaaaggtggtaatcttcatcctgctcatgctcgtaaccccaagcatgaccatgcgctgcgtcggcgtaggcaacagagacttcgtggaaggcctgagcggggcaacatgggtggacgtagtcttagaacacggcggatgcgtgaccacaatggccaaaaacaagccgaccctagacatcgaactgcaaaagacagaggccacgcaactggcaacgctcagaaagctatgcatagaaggcaaaataacaaacatcacgacagacagtaggtgcccgacccaaggcgaagccactctaccggaagaacaagaccaaaactacgtgtgcaagcacacatacgtagaccggggctggggaaatggatgcggcctcagcgggaaaggaagcctcgtcacatgcgcaaaattccagtgcctagaaccaatagaaggcaaggtggtccagtacgagaacctaaaatacaccgtaatcataacagtacacacgggcgaccaacaccaggtaggcaatgaaacgcaaggagtcacagccgaaatcacaccacaagcatcgaccacagaagccatcctacccgagtacggaacactcggacttgagtgcagcccattaacaggcctcgacttcaacgaaatgatcctactgaccatgaaaaacaaagcgtggatggtccaccgacaatggttcttcgacctaccgctaccatggacaagtggggcaacgaccgaaaccccaacatggaacaggaaagaactactggtcacgttcaagaacgcacacgctaaaaagcaagaagtagtagtcctgggctcgcaggagggcgcaatgcacaccgcgctcacaggaaccacagaaatccaaaactcgggagggacctcaatcttcgcggggcacttgaaatgccgcctgaaaatggacaaactcgagcttaagggcatgtcctacgcaatgtgcacaaatacgtttgtcctcaagaaagaagtatcagaaacgcaacacggaacaattctaatcaaagtcgaatacaaaggggaagacgtaccctgtaaaatccccttcagcacagaagacggacaaggaaaagcgcacaacgggcgcttaataacagccaacccagtagtcaccaaaaaggaagaacccgtcaacattgaagcagaaccaccctttggcgagagcaacatcgtgataggaatcggagacaacgcactaaaaataaactggtacaagaaaggaagcacactcggaaaagcattctcaacaacactcaaaggagcccaacggctagcggcccttggcgacacagcatgggacttcggaagtataggcggcgtattcaactccatcggccgagcggtccaccaagtgttcggaggcgcattcaggactctattcgggggcatgagctggatcacacaaggcctaatgggcgccctattgctctggatgggagtcaacgccagggatcgaagcatagcgctggcattcctcgcaaccggaggcgtactggtgttcctggcaaccaacgtccatgcataa

SEQ ID NO: 2474 - RNA, 2037 nt, synthetic construct
  misc_feature 1..2037: note = derived and/or modified CDS sequence (opt11) from DENV-3 Consensus__SSopt-prMEdelstem_TM,(H259N)-JEV
  source 1..2037: mol_type = other RNA
atgaaacgcaagaaaaccagcctgtgcttaatgatgatattaccagcggccctagcattccacctgacatcacgcgacggcgaacccaggatgatagtcggcaaaaacgagcgaggaaaaagcctcctcttcaaaaccgcctccggaataaacatgtgcaccctaatcgctatggacctcggcgagatgtgtgacgacaccgtaacctacaaatgccctcatattacagaagtagaaccggaagacatcgactgctggtgcaacctcacaagcacctgggtaacctacggaacctgcaaccaagccggcgagcacagacgggacaaaagatccgtcgcgctagctccccacgtcggcatgggactagacacacgcacccaaacatggatgagcgccgagggagcctggcgccaagttgagaaagtagaaacatgggctctcaggcatccaggcttcacaatcctcgcactcttcctcgcacactacatcggaacctcgctaacacaaaaagtcgtaatcttcatcctccttatgctagtaaccccgagcatgaccatgcgctgcgtgggcgtcggaaacagagacttcgtagagggcctaagcggagccacgtgggtagacgtagtcctcgaacacggcggatgcgttactacaatggccaaaaataaaccaaccctcgacatagaactccagaaaaccgaagcaacccaactggcaacactacgcaaactatgcatcgagggcaaaataacaaacatcaccaccgactccagatgccccactcaaggcgaagcaacactgccagaagaacaagatcaaaactacgtatgcaaacacacatacgtagacagaggctggggcaacggctgcggactgttcggcaaaggaagcctcgtaacatgcgcaaaattccagtgcctcgagcccatagaaggcaaagtcgtccaatacgagaacctgaaatacacagtcatcatcaccgtacacacaggcgaccaacaccaagtaggaaatgaaacgcaaggagtcacagccgaaataacgccccaggcctccacaacggaagcgatccttccagaatacgggacattaggcttagaatgttcgcccagaaccggcctagacttcaacgaaatgatcctactgaccatgaaaaacaaagcctggatggtccacagacaatggttcttcgacctaccactcccatggacaagcggagccaccaccgagaccccaacctggaacaggaaggaactcctagtcaccttcaaaaatgcccacgcgaagaaacaggaggtcgtagtcctaggctcccaagagggcgccatgaacacagcgttaacaggtgccacagaaatccaaaattcaggcggaacctcaatcttcgccggccacctcaaatgtcgactcaaaatggacaaactcgaactaaaaggaatgtcctacgccatgtgcacaaacacattcgtgctcaagaaagaagtctcagaaacccagcacggcacaatacttataaaagtagaatacaagggtgaggacgtaccctgcaaaatcccattcagcacagaagacggccaaggaaaagcacacaatggacgactgataacggcaaacccagtggtaacaaagaaagaagaaccagtcaacatagaagccgaaccccctttcggcgaaagtaatatcgtgatcggaatcggagacaacgccttaaaaataaactggtacaagaaaggatccacactaggcaaagcattctcgaccacgctcaaaggcgcacaacgcctcgccgccctgggagacaccgcatgggacttcggaagtataggcggagtcttcaactcgatcgggcgcgccgtacaccaagtattcggcggagcattcagaacccttttcggaggtatgtcctggatcacacaaggactaatgggcgcactcctactatggatgggggtcaacgccagagaccgcagcatagcactcgccttccttgcaaccggcggggtactcgtcttcctagccacaaacgtccacgcataa

SEQ ID NO: 2475 - RNA, 2037 nt, synthetic construct
  misc_feature 1..2037: note = derived and/or modified CDS sequence (opt11) from DENV-3 Consensus__SSopt-prMEdelstem_TM,(R186L,A265T)-JEV
  source 1..2037: mol_type = other RNA
atgaaacgcaagaaaacctcactatgcctcatgatgatactacccgccgcactcgcattccacctgaccagccgagacggagagcccagaatgatcgtcggcaaaaacgaaagaggcaaaagcctactcttcaaaaccgcatcaggaatcaacatgtgcacactcatcgccatggacttaggtgaaatgtgtgacgacacggtgacctacaaatgcccccatatcaccgaagtcgaacccgaagacatagactgctggtgcaacctcacaagtacctgggtgacctacggtacctgcaaccaagcaggcgaacaccgacgagacaaaagaagcgtagccctcgcccctcacgtcggcatgggactcgacacccgcacccaaacatggatgagcgcagaaggggcctggcgccaagtagagaaagtagaaacatgggccctcagacacccaggcttcaccatcctcgccctcttcctcgcccactacatcggaacctcgctaacacaaaaagtcgtaatcttcatactcctaatgctagttacccccagcatgactatgcgatgcgtaggggtcggaaaccgcgacttcgtcgagggcctaagcggagccacgtgggtcgacgtggtcctagaacacggaggatgcgtaacaaccatggcgaaaaacaaaccgaccctcgacatcgaactacagaaaacagaagccacacaactggccacattaagaaaactatgcatagaagggaaaataaccaacatcaccaccgactcacgctgcccaacacaaggcgaagcaaccctacccgaagaacaagaccaaaactatgtatgtaaacacacatacgtagacagaggctggggaaacggatgcggcctcttcggtaaaggaagcctagttacatgcgcaaagttccaatgcctcgaaccgatcgaagggaaagtagtacaatacgaaaacctcaaatacaccgtcataataaccgtgcacacaggcgaccaacatcaagtcggcaacgaaacccaaggagtaacagccgaaataacaccccaagcaagcacaacagaggcgatcctcccagagtacggcacactaggcctcgaatgcagccctctcaccggactagacttcaacgagatgatactcttaaccatgaaaaacaaagcgtggatggtacaccgacaatggtttttcgacctcccgcttccatggaccagcggcgcaacaaccgaaacgccaacgtggaacagaaaagaactcctagtaaccttcaaaaacgcacacgccaaaaagcaagaggtagtggtactgggctcacaagaaggcgcaatgcacaccgccctcacggggacgaccgagatccaaaactcgggaggcacatccatcttcgccggccacttaaaatgccgcctaaaaatggacaaactcgagctaaagggcatgagctacgccatgtgcacaaacacattcgtactcaagaaggaagtttcggaaacccaacacggcactatcctcatcaaagtcgaatacaaaggagaagatgtgccgtgcaaaataccctttagcacagaagacggacaaggcaaagcacacaacggccgcttaatcactgcaaaccccgtagtaacaaagaaagaggaacccgtcaacatcgaagcggaaccaccattcggcgaaagcaacatcgtcatcggaatcggagacaacgcactaaaaatcaactggtacaagaaaggttccacactcggaaaagcattctccacaaccctcaaaggcgcccaaagactcgcagccctaggcgacaccgcatgggacttcgggtccataggcggagtgttcaactccatagggcgagcggtacaccaagtatttggcggcgccttccgaacactcttcggaggaatgtcctggatcacacaaggcctcatgggagcactactcctttggatgggagtaaacgcccgagacaggtcaatagcactcgcattcctggccacgggcggagtactcgtattccttgcgaccaacgtacacgcataa

SEQ ID NO: 2476 - RNA, 2016 nt, synthetic construct
  misc_feature 1..2016: note = derived and/or modified CDS sequence (opt11) from DENV-3 Consensus__SSopt-prMEdelstem_TM,del101-107,(R99P,F108N)-JEV
  source 1..2016: mol_type = other RNA
atgaaacgaaagaaaacatcgctatgcctcatgatgatcctacccgcagcactagccttccacctcacatccagagacggagaaccccgcatgattgtaggcaaaaacgaacgcggaaaatcacttctattcaaaaccgcaagcggtatcaacatgtgcactctaatcgccatggatctcggggaaatgtgtgacgacacagtaacctacaaatgcccacacataaccgaagtagaacccgaggacatagactgctggtgcaacctcacaagcacctgggtcacgtacggaacctgcaaccaagctggagaacacagacgcgacaagcgctcagtcgcactagcaccccacgtcggaatgggactagacactaggacccaaacctggatgtcggccgaaggagcatggagacaagtcgaaaaagtagaaacttgggcactccgccacccagggttcacaatactagcactattcctagcccactacataggcacatcactaacccaaaaagtcgtcatatttatcctcctgatgctagtcaccccaagcatgacaatgcgctgcgtcggggtaggaaaccgcgacttcgtagaagggctctccggcgccacatgggtcgacgtcgtactagagcacggaggctgcgtcacaaccatggccaaaaacaaacccacgctagacatcgaactacagaaaactgaagcgacccagctagcaactctgcgcaaactctgcatagagggaaaaatcactaacattaccaccgactcccgctgcccaacgcaaggagaagccaccctgcccgaggaacaggaccaaaactacgtatgcaaacacacctacgtagacccaggtaacgggaaaggcagcctagtaacctgcgcaaaattccaatgcctggaacccatagaagggaaagtcgtccaatacgaaaacctaaaatacacagtaataataacagtacacacaggcgaccaacaccaagtgggaaacgaaacccaaggggtcacggccgaaatcacgccccaagcatcaaccaccgaagcgatactacccgaatacggtaccctaggcctagaatgcagcccacgcaccggcctcgacttcaacgaaatgatacttctgaccatgaaaaacaaagcgtggatggtccaccggcaatggttcttcgacctcccactcccctggacatccggcgccaccaccgagacacccacctggaacagaaaagaactcctcgtaactttcaagaacgctcacgccaaaaagcaagaggtagtagtcctcggcagtcaagaaggcgcaatgcacaccgcactaacgggagcaaccgaaatccaaaacagcggaggcacgtcgatcttcgcaggccacctcaaatgccgcctcaaaatggacaagctcgaactaaaaggaatgagctacgccatgtgcacgaacacattcgtactaaagaaagaggtatcggaaacccaacatggcacaatcctgatcaaggtggagtacaagggcgaagacgtaccctgcaaaatacccttctccaccgaagacggacaaggcaaagcccacaacggccgcctcatcacggccaaccccgtagttaccaagaaagaagaaccagtgaacatagaggccgaaccacccttcggagaaagcaatatagtaatcgggatcggagacaacgccttgaaaatcaactggtacaagaaaggaagcaccctcggaaaagcattctccaccacgctcaaaggcgcacaaagactcgcagcactgggcgacaccgcctgggacttcggcagtatcggcggggtcttcaacagcatcggtcgcgccgtccaccaagtattcggaggagccttccgaactctgttcgggggaatgagctggataacccaaggcctcatgggagccctcctcctatggatgggtgtgaacgcccgcgacagaagcatcgccctagcattcctagcaaccggaggcgtccttgtcttcctcgccacaaacgtacacgcgtaa

SEQ ID NO: 2477 - RNA, 3081 nt, synthetic construct
  misc_feature 1..3081: note = derived and/or modified CDS sequence (opt11) from DENV-3 Consensus__SSc-prME-NS1
  source 1..3081: mol_type = other RNA
atgacatcattgtgcctcatgatgatcctgcccgccgcactcgcattccaccttacctcgcgggacggcgagcccagaatgatagtcggcaaaaacgaaaggggaaaatctctcctgttcaaaaccgcgagcggaataaacatgtgcacactaatagccatggacttaggagaaatgtgcgacgacactgtgacctacaaatgcccccacatcacggaagtcgaaccggaagacatagactgctggtgcaatctcactagcacctgggtaacctacggaacgtgcaatcaagctggtgaacacaggcgagacaaaagaagcgtagcactggccccacacgtcgggatggggctagacacaagaacccaaacttggatgagtgcagaaggggcctggcgacaagtcgaaaaagtcgagacgtgggcactcaggcacccgggattcaccatcctcgcactcttcctagcccactacatcgggacctcccttacccaaaaagtcgtaatattcatactattaatgctagtgaccccgtccatgacaatgcgctgtgtcggagtcggtaatagagacttcgtcgagggattgagcggggcaacgtgggtagacgtcgttctcgagcacggcggatgtgtcaccacgatggcaaagaacaaacccacccttgatatagaattacaaaagacggaagccacccaattagcaacactcagaaagctctgcattgaaggaaagataacgaacatcacaactgactccagatgcccaacccaaggcgaagcaacgctgccggaagaacaggaccaaaactacgtgtgcaaacacacctacgtggacaggggctggggcaacggatgcggactattcggaaaaggaagcctcgtcacttgcgcaaagttccaatgcctcgaacccatagaagggaaagtcgtacagtacgaaaacctcaaatacactgtaattatcacagtccatacgggagaccagcaccaagtcggcaacgaaacacagggtgtcaccgccgaaataacaccacaagcatccacaacggaggcaatactgcccgaatacgggaccctagggctggagtgcagcccgcgcacgggcctcgacttcaacgaaatgatactcctcaccatgaagaataaagcatggatggtccacaggcaatggttcttcgacctgccactgccgtggaccagcggggcgaccaccgaaaccccaacctggaatcggaaagagcttctagttactttcaaaaacgcccacgcaaagaaacaagaagtcgtagtcctgggatcgcaagaaggcgcaatgcacaccgcacttacgggcgcaaccgagatccaaaactccgggggaacctccatcttcgcaggacacctaaaatgccgcctcaaaatggataaactcgaactcaaaggcatgtcctacgccatgtgcacaaatacgtttgtcctaaagaaagaagtctcggaaacgcaacacggaaccatacttatcaaagtagaatacaagggcgaagacgtcccatgcaaaatccccttcagcaccgaagacggccagggaaaggcacacaatggccgcctaataaccgcaaaccccgtagttacgaaaaaggaagaaccagtgaacatagaagctgaacccccattcggggaatccaatatagtaatcggcatcggcgacaacgccctgaaaatcaactggtacaagaaagggagttcaataggaaaaatgttcgaagcaacagcacggggcgcccgaagaatggcaatcctaggcgacaccgcatgggactttggatctgtaggaggcgttctaaatagcctaggcaagatggtccaccaaatcttcggaagtgcatacacagccctgttcagcggcgtctcatgggttatgaagataggcataggcgtgcttctcacctggataggattgaacagcaaaaacaccagcatgagcttctcctgcatcgcaatcggaataataaccctgtacctaggagccgtcgtccaagccgatatgggatgtgtgatcaactggaaagggaaagaactcaaatgcggcagcggaatcttcgtcacgaacgaggtccacacatggaccgagcaatataaattccaagcagactcccccaagcgcctagcgaccgcaatcgccggagcctgggaaaacggcgtgtgcggaatcagatcgacaacgaggatggaaaacctcctatggaaacaaatcgcaaacgaactcaactatatcctatgggaaaacaacatcaaattgacagtagtggtcggcgacatcataggcgtgctagaacaagggaaacgaaccctaaccccacaacccatggagctcaaatacagctggaagacatgggggaaagcaaagatcgtcacagccgaaacacagaacagctcgttcataatcgatggaccaaacacaccagaatgcccatcagtaagcagggcctggaacgtatgggaagtcgaggactacggcttcggcgtcttcacaaccaacatatggctaaagctaagagaggtgtacacccagctatgcgaccacagactcatgagtgcggcagtcaaagacgagagagctgtccacgccgacatgggctactggatcgaatcacagaaaaacggaagctggaaactagagaaggcaagcctaatagaggtgaaaacgtgcacctggccgaaaagccacacgctctggagcaatggcgtgctcgaatcagacatgatcatccccaaaagcctcgcaggccccatctcccaacataaccaccgacccggttaccacacccaaaccgcaggcccgtggcacctgggcaagctggaactcgacttcaactactgtgaggggaccaccgttgtaataacagaaaactgcggaacccggggcccgagcttacgaacgacaacagtcagcggcaaactcattcatgaatggtgctgcagatcctgcacacttcccccactaagatacatgggagaggacggatgctggtacgggatggaaataagacccataagcgagaaagaagaaaacatggtcaagagtctggtcagcgcataa

SEQ ID NO: 2478 - RNA, 1824 nt, synthetic construct
  misc_feature 1..1824: note = derived and/or modified CDS sequence (opt11) from DENV-3 Consensus__SSm-EdelTM-linker-ferritin
  source 1..1824: mol_type = other RNA
atgacacaaaaagtcgttatattcatcctactcatgctagtgacaccatcgatgaccatgcgctgcgtaggcgtgggaaaccgggatttcgtagagggcctatccggagcaacatgggtagacgtagtactcgaacacggcgggtgcgtgacaacaatggccaagaacaaacccaccttagacatagagctccaaaaaacagaagccacacagctcgcaacgctcaggaaactatgcatcgaagggaaaatcactaacatcactaccgacagccgatgcccaacccagggcgaggcaaccctaccagaagaacaagaccaaaactacgtctgcaaacacacatacgtcgacagaggctggggcaacggctgtggactattcggaaaaggctccctggtcacctgcgcaaaattccagtgcctagaaccaatcgaagggaaagtcgtacaatacgaaaacctcaaatacacagtcatcatcacggtacatacaggagaccaacaccaagtcgggaacgaaacccaaggagtcacggccgaaatcacaccccaagccagcaccaccgaagcgatactacccgaatacggcacactcggccttgaatgcagcccccggacaggcctagacttcaacgaaatgatactactcaccatgaaaaacaaagcctggatggtccacagacaatggttcttcgacctgcccctcccatggacgtccggcgcaacgaccgaaacacccacgtggaaccgcaaagagctactcgtaacattcaaaaacgcccacgccaaaaaacaagaagtcgtagtacttggatcacaagaaggagcaatgcacaccgcactcaccggcgccacagagatacaaaactcaggcggaacctcaatctttgccggccacctcaaatgccgcctcaaaatggataaactcgaactcaaaggcatgtcctacgcaatgtgcaccaacactttcgtcctcaaaaaagaggtctcagaaacccaacacggaaccatcctaatcaaagtagaatacaaaggcgaagacgtgccatgcaaaatacccttcagcacagaagacggccaaggcaaagcccacaacggccgactaatcaccgcaaaccccgtagtcacgaaaaaagaagagcccgtcaacatagaagcggaaccacccttcggcgaaagcaacatcgtcatcggcatcggcgacaacgccttaaaaatcaactggtacaaaaaaggctcatccataggaaaaatgttcgaagccacagccaggggcgcgcgccgcatggcaatactcggcgacaccgcatgggacttcggaagctcagggggtgacatcatcaaactcctgaacgaacaagtcaacaaagaaatgcaatccagcaacctatacatgtccatgagctcctggtgctacacccacagcctcgacggagccggactattcctcttcgaccacgccgcagaagaatacgaacacgccaaaaaactcatcatcttcctcaacgaaaacaacgtccccgtacaactaacatccatatcggcccccgaacacaaattcgaaggcctcacacaaatcttccagaaagcatacgaacacgagcagcacatcagcgaatccataaacaacatagtcgaccacgccatcaaaagcaaggaccacgccacattcaacttcctacaatggtacgtcgccgaacagcacgaagaggaagtgctattcaaagacatcctggacaagatagaactcatcggcaacgaaaaccacggactttatctcgccgaccaatacgtaaaaggcatcgcaaagtccagaaaatcctga

SEQ ID NO: 2479 - RNA, 1821 nt, synthetic construct
  misc_feature 1..1821: note = derived and/or modified CDS sequence (opt11) from DENV-3 Consensus__SStPA-WHbcAg-linker-EdelTM
  source 1..1821: mol_type = other RNA
atggacgccatgaaacggggactctgctgcgtacttctgctctgcggagccgttttcgtagactccgtaacagggatggacatagacccctacaaagagttcggctcatcctaccaactcctaaacttcctaccactcgacttcttccccgacctcaacgccctagtcgacaccgccaccgcactctacgaagaagaactaaccgggcgcgaacactgcagcccccaccacaccgccatcaggcaggcgctcgtatgctgggacgaactaacaaaactcatcgcatggatgtcaagcaacatcacctcggaacaagtaagaaccataatagtcaaccacgtaaacgacacctggggactgaaagtcagacagtcactgtggttccacctctcatgcctcactttcggacagcacactgtacaagagttcctcgtcagcttcggcgtatggatcagaacccccgcaccctatcgaccacccaacgcccccatcttatccacactgcccgaacacacagtaatctgcggaggcggcggcagcgggggcggcgggatgcgctgtgtaggcgtcggcaacagggacttcgtagaaggcctaagcggagccacatgggtagacgtagtcctagaacacgggggatgcgtaaccacaatggccaaaaacaagccgaccctcgacatcgaactacagaaaacagaagccacccaactcgccacactccgcaaactatgcatagaaggaaaaatcaccaacatcaccaccgactcgcgctgccccacccaaggcgaagccacactcccagaagaacaagaccaaaactacgtatgcaagcacacctacgtagaccgaggctggggcaacggctgcggcttatttggtaagggtagcctagtaacatgcgccaaattccaatgcctcgaaccgatagaaggaaaagtagtacaatacgaaaacctcaaatacaccgtaataatcacagtccacaccggcgaccaacaccaggtcgggaacgaaacccaaggagtcacagccgaaataaccccacaggcatccaccacagaagcaatactacccgaatacggaacactgggactcgaatgcagccccagaaccggtctagacttcaacgaaatgatactactaaccatgaaaaacaaagcctggatggtccacagacaatggttcttcgacctccccctcccatggacaagcggcgccacaacagagacacccacatggaacagaaaagaactcctagtcaccttcaagaacgcgcacgcaaagaaacaagaagtagtcgttctaggatcccaagagggcgccatgcacaccgccctgaccggagccaccgaaatccagaactcaggaggcacatccatttttgccggacacctgaaatgccgactaaaaatggacaaactcgaactcaaaggcatgtcttacgccatgtgcacaaacacattcgtcctaaagaaagaagtctccgaaacccaacacggcaccatcctcatcaaagtcgagtacaaaggagaagacgtaccatgcaaaatcccattcagcacagaagatggtcaaggcaaagcccacaacggacgccttataaccgccaaccccgtcgtcaccaagaaagaggagcccgtcaacatcgaagccgaaccacccttcggcgaaagtaacatagtcatcggaataggcgacaacgccctaaaaataaactggtacaagaaaggaagctcaatcggcaaaatgttcgaagcaacagccaggggcgcgcgcagaatggcaatcctcggcgacacagcctgggacttcgggagctag

SEQ ID NO: 2480 - RNA, 2248 nt, synthetic construct
  misc_feature 1..2248: note = mRNA product Design1 comprising derived and/or modified sequence from DENV-1 CYD23__SSc-prME (CDS opt1)
  source 1..2248: mol_type = other RNA
gggagaaagcttaccatgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2481 - RNA, 2248 nt, synthetic construct
  misc_feature 1..2248: note = mRNA product Design1 comprising derived and/or modified sequence from DENV-1 CYD23__SSc-prME(F108S) (CDS opt1)
  source 1..2248: mol_type = other RNA
gggagaaagcttaccatgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgtccggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2482 - RNA, 2248 nt, synthetic construct
  misc_feature 1..2248: note = mRNA product Design1 comprising derived and/or modified sequence from DENV-1 CYD23__SSc-prMEdelstem_TM-JEV (CDS opt1)
  source 1..2248: mol_type = other RNA
gggagaaagcttaccatgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2483 - RNA, 2596 nt, synthetic construct
  misc_feature 1..2596: note = mRNA product Design1 comprising derived and/or modified sequence from DENV-1 CYD23__C-P2A-SSc-prME (CDS opt1)
  source 1..2596: mol_type = other RNA
gggagaaagcttaccatgaacaaccagcgcaagaagaccgcccggccgagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaagaacttcgacctgctcaagctggccggcgacgtggagagcaaccccgggccgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2484 - RNA, 2260 nt, synthetic construct
  misc_feature 1..2260: note = mRNA product Design1 comprising derived and/or modified sequence from DENV-1 CYD23__SSopt-prME(F108S) (CDS opt1)
  source 1..2260: mol_type = other RNA
gggagaaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgtccggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2485 - RNA, 2260 nt, synthetic construct
  misc_feature 1..2260: note = mRNA product Design1 comprising derived and/or modified sequence from DENV-1 CYD23__SSopt-prME(F96H) (CDS opt1)
  source 1..2260: mol_type = other RNA
gggagaaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcacccacgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2486 - RNA, 2260 nt, synthetic construct
  misc_feature 1..2260: note = mRNA product Design1 comprising derived and/or modified sequence from DENV-1 CYD23__SSopt-prME(S186F) (CDS opt1)
  source 1..2260: mol_type = other RNA
gggagaaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcttcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2487 - RNA, 2260 nt, synthetic construct
  misc_feature 1..2260: note = mRNA product Design1 comprising derived and/or modified sequence from DENV-1 CYD23__SSopt-prME(R188L) (CDS opt1)
  source 1..2260: mol_type = other RNA
gggagaaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagccccctgacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2488 - RNA, 2260 nt, synthetic construct
  misc_feature 1..2260: note = mRNA product Design1 comprising derived and/or modified sequence from DENV-1 CYD23__SSopt-pr(D104A)MEdelstem_TM,(F108S)-JEV (CDS opt1)
  source 1..2260: mol_type = other RNA
gggagaaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgccaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgagcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2489 - RNA, 2260 nt, synthetic construct
  misc_feature 1..2260: note = mRNA product Design1 comprising derived and/or modified sequence from DENV-1 CYD23__SSopt-prMEdelstem_TM,(H261N)-JEV (CDS opt1)
  source 1..2260: mol_type = other RNA
gggagaaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgaacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2490 - RNA, 2260 nt, synthetic construct
  misc_feature 1..2260: note = mRNA product Design1 comprising derived and/or modified sequence from DENV-1 CYD23__SSopt-prMEdelstem_TM,(R188L,A267T)-JEV (CDS opt1)
  source 1..2260: mol_type = other RNA
gggagaaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagccccctgacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacggggaccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2491 - RNA, 2248 nt, synthetic construct
  misc_feature 1..2248: note = mRNA product Design1 comprising derived and/or modified sequence from DENV-2 CYD2-T__SSc-prME (CDS opt1)
  source 1..2248: mol_type = other RNA
gggagaaagcttaccatgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2492 - RNA, 2248 nt, synthetic construct
  misc_feature 1..2248: note = mRNA product Design1 comprising derived and/or modified sequence from DENV-2 CYD2-T__SSc-prME(F108S) (CDS opt1)
  source 1..2248: mol_type = other RNA
gggagaaagcttaccatgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctctccgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2493 - RNA, 2248 nt, synthetic construct
  misc_feature 1..2248: note = mRNA product Design1 comprising derived and/or modified sequence from DENV-2 CYD2-T__SSc-prMEdelstem_TM-JEV (CDS opt1)
  source 1..2248: mol_type = other RNA
gggagaaagcttaccatgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2494 - RNA, 1549 nt, synthetic construct
  misc_feature 1..1549: note = mRNA product Design1 comprising derived and/or modified sequence from DENV-2 CYD2-T__SSm-EdelTM (CDS opt1)
  source 1..1549: mol_type = other RNA
gggagaaagcttaccatgttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2495 - RNA, 2596 nt, synthetic construct
  misc_feature 1..2596: note = mRNA product Design1 comprising derived and/or modified sequence from DENV-2 CYD2-T__C-P2A-SSc-prME (CDS opt1)
  source 1..2596: mol_type = other RNA
gggagaaagcttaccatgaacaaccagcgcaagaaggccaagaacaccccgttcaacatgctgaagcgggagcgcaaccgggtgagcaccgtccagcagctcacgaagcgcttctccctgggcatgctgcaggggcggggccccctcaagctgttcatggccctggtggcgttcctccgcttcctgaccatcccgcccaccgccgggatcctgaagcggtggggcaccatcaagaagagcaaggccatcaacgtgctccgcgggttccggaaggagatcggccgcatgctgaacatcctgaaccggcgccggcgcaacttcgacctgctcaagctggccggcgacgtggagagcaaccccgggccgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2496 - RNA, 2260 nt, synthetic construct
  misc_feature 1..2260: note = mRNA product Design1 comprising derived and/or modified sequence from DENV-2 CYD2-T__SSopt-prME(F108S) (CDS opt1)
  source 1..2260: mol_type = other RNA
gggagaaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctctccgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2497 - RNA, 2260 nt, synthetic construct
  misc_feature 1..2260: note = mRNA product Design1 comprising derived and/or modified sequence from DENV-2 CYD2-T__SSopt-prME(M96H) (CDS opt1)
  source 1..2260: mol_type = other RNA
gggagaaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactcccacgtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2498 - RNA, 2260 nt, synthetic construct
  misc_feature 1..2260: note = mRNA product Design1 comprising derived and/or modified sequence from DENV-2 CYD2-T__SSopt-prME(S186F) (CDS opt1)
  source 1..2260: mol_type = other RNA
gggagaaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgcttcccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2499 - RNA, 2260 nt, synthetic construct
  misc_feature 1..2260: note = mRNA product Design1 comprising derived and/or modified sequence from DENV-2 CYD2-T__SSopt-prME(R188L) (CDS opt1)
  source 1..2260: mol_type = other RNA
gggagaaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgctgacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2500 - RNA, 2260 nt, synthetic construct
  misc_feature 1..2260: note = mRNA product Design1 comprising derived and/or modified sequence from DENV-2 CYD2-T__SSopt-pr(D104A)MEdelstem_TM,(F108S)-JEV (CDS opt1)
  source 1..2260: mol_type = other RNA
gggagaaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgccaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcagcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2501 - RNA, 2260 nt, synthetic construct
  misc_feature 1..2260: note = mRNA product Design1 comprising derived and/or modified sequence from DENV-2 CYD2-T__SSopt-prMEdelstem_TM,(H261N)-JEV (CDS opt1)
  source 1..2260: mol_type = other RNA
gggagaaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgaacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2502 - RNA, 2260 nt, synthetic construct
  misc_feature 1..2260: note = mRNA product Design1 comprising derived and/or modified sequence from DENV-2 CYD2-T__SSopt-prMEdelstem_TM,(R188L,A267T)-JEV (CDS opt1)
  source 1..2260: mol_type = other RNA
gggagaaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgctgacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcaccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2503 - RNA, 2248 nt, synthetic construct
  misc_feature 1..2248: note = mRNA product Design1 comprising derived and/or modified sequence from DENV-4 Consensus__SSc-prME (CDS opt1)
  source 1..2248: mol_type = other RNA
gggagaaagcttaccatgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2504 - RNA, 2248 nt, synthetic construct
  misc_feature 1..2248: note = mRNA product Design1 comprising derived and/or modified sequence from DENV-4 Consensus__SSc-prME(F108S) (CDS opt1)
  source 1..2248: mol_type = other RNA
gggagaaagcttaccatgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgtccgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2505 - RNA, 2248 nt, synthetic construct
  misc_feature 1..2248: note = mRNA product Design1 comprising derived and/or modified sequence from DENV-4 Consensus__SSc-prMEdelstem_TM-JEV (CDS opt1)
  source 1..2248: mol_type = other RNA
gggagaaagcttaccatgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2506 - RNA, 1549 nt, synthetic construct
  misc_feature 1..1549: note = mRNA product Design1 comprising derived and/or modified sequence from DENV-4 Consensus__SSm-EdelTM (CDS opt1)
  source 1..1549: mol_type = other RNA
gggagaaagcttaccatgatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2507 - RNA, 2593 nt, synthetic construct
  misc_feature 1..2593: note = mRNA product Design1 comprising derived and/or modified sequence from DENV-4 Consensus__C-P2A-SSc-prME (CDS opt1)
  source 1..2593: mol_type = other RNA
gggagaaagcttaccatgaaccagcgcaagaaggtggtccggcccccgttcaacatgctgaagcgcgagcggaaccgcgtgagcaccccgcagggcctcgtgaagcggttctccaccgggctgttcagcggcaaggggcccctgcgcatggtcctcgccttcatcacgttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgcaacttcgacctgctcaagctggccggcgacgtggagagcaaccccgggccgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2508 - RNA, 2260 nt, synthetic construct
  misc_feature 1..2260: note = mRNA product Design1 comprising derived and/or modified sequence from DENV-4 Consensus__SSopt-prME(F108S) (CDS opt1)
  source 1..2260: mol_type = other RNA
gggagaaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgtccgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2509 - RNA, 2260 nt, synthetic construct
  misc_feature 1..2260: note = mRNA product Design1 comprising derived and/or modified sequence from DENV-4 Consensus__SSopt-prME(V96H) (CDS opt1)
  source 1..2260: mol_type = other RNA
gggagaaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgaccacgtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2510 - RNA, 2260 nt, synthetic construct
  misc_feature 1..2260: note = mRNA product Design1 comprising derived and/or modified sequence from DENV-4 Consensus__SSopt-prME(E186F) (CDS opt1)
  source 1..2260: mol_type = other RNA
gggagaaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcttcccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2511 - RNA, 2260 nt, synthetic construct
  misc_feature 1..2260: note = mRNA product Design1 comprising derived and/or modified sequence from DENV-4 Consensus__SSopt-prME(R188L) (CDS opt1)
  source 1..2260: mol_type = other RNA
gggagaaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagcccctgagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2512 - RNA, 2260 nt, synthetic construct
  misc_feature 1..2260: note = mRNA product Design1 comprising derived and/or modified sequence from DENV-4 Consensus__SSopt-pr(D104A)MEdelstem_TM,(F108S)-JEV (CDS opt1)
  source 1..2260: mol_type = other RNA
gggagaaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggccaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgagcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2513 - RNA, 2260 nt, synthetic construct
  misc_feature 1..2260: note = mRNA product Design1 comprising derived and/or modified sequence from DENV-4 Consensus__SSopt-prMEdelstem_TM,(H261N)-JEV (CDS opt1)
  source 1..2260: mol_type = other RNA
gggagaaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgaacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2514 - RNA, 2260 nt, synthetic construct
  misc_feature 1..2260: note = mRNA product Design1 comprising derived and/or modified sequence from DENV-4 Consensus__SSopt-prMEdelstem_TM,(R188L,A267T)-JEV (CDS opt1)
  source 1..2260: mol_type = other RNA
gggagaaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagcccctgagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcaccaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2515 - RNA, 2242 nt, synthetic construct
  misc_feature 1..2242: note = mRNA product Design1 comprising derived and/or modified sequence from DENV-3 Consensus__SSc-prME (CDS opt1)
  source 1..2242: mol_type = other RNA
gggagaaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2516 - RNA, 2242 nt, synthetic construct
  misc_feature 1..2242: note = mRNA product Design1 comprising derived and/or modified sequence from DENV-3 Consensus__SSc-prME(F108S) (CDS opt1)
  source 1..2242: mol_type = other RNA
gggagaaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctctccgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2517 - RNA, 2242 nt, synthetic construct
  misc_feature 1..2242: note = mRNA product Design1 comprising derived and/or modified sequence from DENV-3 Consensus__SSc-prME(R186L) (CDS opt1)
  source 1..2242: mol_type = other RNA
gggagaaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2518 - RNA, 2242 nt, synthetic construct
  misc_feature 1..2242: note = mRNA product Design1 comprising derived and/or modified sequence from DENV-3 Consensus__SSc-prME(A265T) (CDS opt1)
  source 1..2242: mol_type = other RNA
gggagaaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2519 - RNA, 2242 nt, synthetic construct
  misc_feature 1..2242: note = mRNA product Design1 comprising derived and/or modified sequence from DENV-3 Consensus__SSc-prMEdelstem_TM-JEV (CDS opt1)
  source 1..2242: mol_type = other RNA
gggagaaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2520 - RNA, 1543 nt, synthetic construct
  misc_feature 1..1543: note = mRNA product Design1 comprising derived and/or modified sequence from DENV-3 Consensus__SSm-EdelTM (CDS opt1)
  source 1..1543: mol_type = other RNA
gggagaaagcttaccatgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2521 - RNA, 2590 nt, synthetic construct
  misc_feature 1..2590: note = mRNA product Design1 comprising derived and/or modified sequence from DENV-3 Consensus__C-P2A-SSc-prME (CDS opt1)
  source 1..2590: mol_type = other RNA
gggagaaagcttaccatgaacaaccagcgcaagaagaccggcaagccgagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagagcggcgccatcaaggtcctgaaggggttcaagaaggagatctccaacatgctgagcatcatcaacaagcggaagaagaacttcgacctgctcaagctggccggcgacgtggagagcaaccccgggccgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2522 - RNA, 2254 nt, synthetic construct
  misc_feature 1..2254: note = mRNA product Design1 comprising derived and/or modified sequence from DENV-3 Consensus__SSopt-prME (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2523 - RNA, 2254 nt, synthetic construct
  misc_feature 1..2254: note = mRNA product Design1 comprising derived and/or modified sequence from DENV-3 Consensus__SSopt-prME(F108S) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2524 - RNA, 2254 nt, synthetic construct
  misc_feature 1..2254: note = mRNA product Design1 comprising derived and/or modified sequence from DENV-3 Consensus__SSopt-prME(H27N) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagaacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2525 - RNA, 2254 nt, synthetic construct
  misc_feature 1..2254: note = mRNA product Design1 comprising derived and/or modified sequence from DENV-3 Consensus__SSopt-prME(T76I) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccatccagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2526 - RNA, 2254 nt, synthetic construct
  misc_feature 1..2254: note = mRNA product Design1 comprising derived and/or modified sequence from DENV-3 Consensus__SSopt-prME(N89D) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccaggactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2527 - RNA, 2254 nt, synthetic construct
  misc_feature 1..2254: note = mRNA product Design1 comprising derived and/or modified sequence from DENV-3 Consensus__SSopt-prME(Y96H) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacccacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2528 - RNA, 2254 nt, synthetic construct
  misc_feature 1..2254: note = mRNA product Design1 comprising derived and/or modified sequence from DENV-3 Consensus__SSopt-prME(K110E) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcggggagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2529 - RNA, 2254 nt, synthetic construct
  misc_feature 1..2254: note = mRNA product Design1 comprising derived and/or modified sequence from DENV-3 Consensus__SSopt-prME(H149N) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagaaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2530 - RNA, 2254 nt, synthetic construct
  misc_feature 1..2254: note = mRNA product Design1 comprising derived and/or modified sequence from DENV-3 Consensus__SSopt-prME(S184F) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgcttcccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2531 - RNA, 2254 nt, synthetic construct
  misc_feature 1..2254: note = mRNA product Design1 comprising derived and/or modified sequence from DENV-3 Consensus__SSopt-prME(R186L) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2532 - RNA, 2254 nt, synthetic construct
  misc_feature 1..2254: note = mRNA product Design1 comprising derived and/or modified sequence from DENV-3 Consensus__SSopt-prME(N240S) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagagcgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2533 - RNA, 2254 nt, synthetic construct
  misc_feature 1..2254: note = mRNA product Design1 comprising derived and/or modified sequence from DENV-3 Consensus__SSopt-prME(M258L) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgctgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2534 - RNA, 2254 nt, synthetic construct
  misc_feature 1..2254: note = mRNA product Design1 comprising derived and/or modified sequence from DENV-3 Consensus__SSopt-prME(H259N) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgaacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2535 - RNA, 2254 nt, synthetic construct
  misc_feature 1..2254: note = mRNA product Design1 comprising derived and/or modified sequence from DENV-3 Consensus__SSopt-prME(H259R) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcgcacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2536 - RNA, 2254 nt, synthetic construct
  misc_feature 1..2254: note = mRNA product Design1 comprising derived and/or modified sequence from DENV-3 Consensus__SSopt-prME(A265T) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2537 - RNA, 2254 nt, synthetic construct
  misc_feature 1..2254: note = mRNA product Design1 comprising derived and/or modified sequence from DENV-3 Consensus__SSopt-prME(S296G) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgggctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2538 - RNA, 2254 nt, synthetic construct
  misc_feature 1..2254: note = mRNA product Design1 comprising derived and/or modified sequence from DENV-3 Consensus__SSopt-prME(S311R) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtccgcgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2539 - RNA, 2254 nt, synthetic construct
  misc_feature 1..2254: note = mRNA product Design1 comprising derived and/or modified sequence from DENV-3 Consensus__SSopt-prME(K321T) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaccgtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2540 - RNA, 2254 nt, synthetic construct
  misc_feature 1..2254: note = mRNA product Design1 comprising derived and/or modified sequence from DENV-3 Consensus__SSopt-prME(G28C,H242C) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcactgcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcctgcgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2541 - RNA, 2254 nt, synthetic construct
  misc_feature 1..2254: note = mRNA product Design1 comprising derived and/or modified sequence from DENV-3 Consensus__SSopt-prME(R186L,A265T) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2542 - RNA, 2254 nt, synthetic construct
  misc_feature 1..2254: note = mRNA product Design1 comprising derived and/or modified sequence from DENV-3 Consensus__SSopt-pr(D104A)ME(F108S) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2543 - RNA, 2254 nt, synthetic construct
  misc_feature 1..2254: note = mRNA product Design1 comprising derived and/or modified sequence from DENV-3 Consensus__SSopt-pr(D104A)ME(R186L,A265T) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2544 - RNA, 2254 nt, synthetic construct
  misc_feature 1..2254: note = mRNA product Design1 comprising derived and/or modified sequence from DENV-3 Consensus__SSopt-pr(D104A)ME(F108S,R186L,A265T) (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2545 - RNA, 2233 nt, synthetic construct
  misc_feature 1..2233: note = mRNA product Design1 comprising derived and/or modified sequence from DENV-3 Consensus__SSopt-prMEdel101-107,(R99P,F108N) (CDS opt1)
  source 1..2233: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccccgggaacgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2546 - RNA, 2254 nt, synthetic construct
  misc_feature 1..2254: note = mRNA product Design1 comprising derived and/or modified sequence from DENV-3 Consensus__SSopt-prMEdelstem_TM-JEV (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2547 - RNA, 2254 nt, synthetic construct
  misc_feature 1..2254: note = mRNA product Design1 comprising derived and/or modified sequence from DENV-3 Consensus__SSopt-pr(D104A)MEdelstem_TM,(F108S)-JEV (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2548 - RNA, 2254 nt, synthetic construct
  misc_feature 1..2254: note = mRNA product Design1 comprising derived and/or modified sequence from DENV-3 Consensus__SSopt-pr(D104A)MEdelstem_TM,(R186L,A265T)-JEV (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2549 - RNA, 2254 nt, synthetic construct
  misc_feature 1..2254: note = mRNA product Design1 comprising derived and/or modified sequence from DENV-3 Consensus__SSopt-pr(D104A)MEdelstem_TM,(F108S,R186L,A265T)- JEV (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2550 - RNA, 2254 nt, synthetic construct
  misc_feature 1..2254: note = mRNA product Design1 comprising derived and/or modified sequence from DENV-3 Consensus__SSopt-prMEdelstem_TM,(H259N)-JEV (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgaacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2551 - RNA, 2254 nt, synthetic construct
  misc_feature 1..2254: note = mRNA product Design1 comprising derived and/or modified sequence from DENV-3 Consensus__SSopt-prMEdelstem_TM,(R186L,A265T)-JEV (CDS opt1)
  source 1..2254: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2552 - RNA, 2233 nt, synthetic construct
  misc_feature 1..2233: note = mRNA product Design1 comprising derived and/or modified sequence from DENV-3 Consensus__SSopt-prMEdelstem_TM,del101-107,(R99P,F108N)-JEV (CDS opt1)
  source 1..2233: mol_type = other RNA
gggagaaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccccgggaacgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2553 - RNA, 3298 nt, synthetic construct
  misc_feature 1..3298: note = mRNA product Design1 comprising derived and/or modified sequence from DENV-3 Consensus__SSc-prME-NS1 (CDS opt1)
  source 1..3298: mol_type = other RNA
gggagaaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2554 - RNA, 2041 nt, synthetic construct
  misc_feature 1..2041: note = mRNA product Design1 comprising derived and/or modified sequence from DENV-3 Consensus__SSm-EdelTM-linker-ferritin (CDS opt1)
  source 1..2041: mol_type = other RNA
gggagaaagcttaccatgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccagcggcggggacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2555 - RNA, 2038 nt, synthetic construct
  misc_feature 1..2038: note = mRNA product Design1 comprising derived and/or modified sequence from DENV-3 Consensus__SStPA-WHbcAg-linker-EdelTM (CDS opt1)
  source 1..2038: mol_type = other RNA
gggagaaagcttaccatggacgccatgaagcgcggcctgtgctgcgtgctcctgctgtgcggggccgtcttcgtggacagcgtgaccggcatggacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtgcgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgcggcgggggcgggagcggcgggggcggcatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2556 - RNA, 5722 nt, synthetic construct
  misc_feature 1..5722: note = mRNA product Design1 comprising derived and/or modified sequence from DENV-3 Consensus__SSc-prME-NS1-[IRES]-NS3 (CDS opt1)
  source 1..5722: mol_type = other RNA
gggagaaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2557 - RNA, 5722 nt, synthetic construct
  misc_feature 1..5722: note = mRNA product Design1 comprising derived and/or modified sequence from DENV-3 Consensus__NS3-[IRES]- SSc-prME-NS1 (CDS opt1)
  source 1..5722: mol_type = other RNA
gggagaaagcttaccatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2558 - RNA, 4465 nt, synthetic construct
  misc_feature 1..4465: note = mRNA product Design1 comprising derived and/or modified sequence from DENV-3 Consensus__SSm-EdelTM-linker-ferritin-[IRES]-NS3 (CDS opt1)
  source 1..4465: mol_type = other RNA
gggagaaagcttaccatgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccagcggcggggacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2559 - RNA, 4462 nt, synthetic construct
  misc_feature 1..4462: note = mRNA product Design1 comprising derived and/or modified sequence from DENV-3 Consensus__SStPA-WHbcAg-linker-EdelTM-[IRES]-NS3 (CDS opt1)
  source 1..4462: mol_type = other RNA
gggagaaagcttaccatggacgccatgaagcgcggcctgtgctgcgtgctcctgctgtgcggggccgtcttcgtggacagcgtgaccggcatggacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtgcgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgcggcgggggcgggagcggcgggggcggcatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2560 - RNA, 2413 nt, synthetic construct
  misc_feature 1..2413: note = mRNA product Design2 comprising derived and/or modified sequence from DENV-1 CYD23__SSc-prME (CDS opt1) R3539/R3540
  source 1..2413: mol_type = other RNA
ggggcgctgcctacggaggtggcagccatctccttctcggcatcaagcttaccatgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2561 - RNA, 2413 nt, synthetic construct
  misc_feature 1..2413: note = mRNA product Design2 comprising derived and/or modified sequence from DENV-1 CYD23__SSc-prME(F108S) (CDS opt1)
  source 1..2413: mol_type = other RNA
ggggcgctgcctacggaggtggcagccatctccttctcggcatcaagcttaccatgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgtccggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2562 - RNA, 2413 nt, synthetic construct
  misc_feature 1..2413: note = mRNA product Design2 comprising derived and/or modified sequence from DENV-1 CYD23__SSc-prMEdelstem_TM-JEV (CDS opt1) R3541/R3542
  source 1..2413: mol_type = other RNA
ggggcgctgcctacggaggtggcagccatctccttctcggcatcaagcttaccatgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2563 - RNA, 2761 nt, synthetic construct
  misc_feature 1..2761: note = mRNA product Design2 comprising derived and/or modified sequence from DENV-1 CYD23__C-P2A-SSc-prME (CDS opt1) R3781/R3782
  source 1..2761: mol_type = other RNA
ggggcgctgcctacggaggtggcagccatctccttctcggcatcaagcttaccatgaacaaccagcgcaagaagaccgcccggccgagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaagaacttcgacctgctcaagctggccggcgacgtggagagcaaccccgggccgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2564 - RNA, 2425 nt, synthetic construct
  misc_feature 1..2425: note = mRNA product Design2 comprising derived and/or modified sequence from DENV-1 CYD23__SSopt-prME(F108S) (CDS opt1)
  source 1..2425: mol_type = other RNA
ggggcgctgcctacggaggtggcagccatctccttctcggcatcaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgtccggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2565 - RNA, 2425 nt, synthetic construct
  misc_feature 1..2425: note = mRNA product Design2 comprising derived and/or modified sequence from DENV-1 CYD23__SSopt-prME(F96H) (CDS opt1)
  source 1..2425: mol_type = other RNA
ggggcgctgcctacggaggtggcagccatctccttctcggcatcaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcacccacgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2566 - RNA, 2425 nt, synthetic construct
  misc_feature 1..2425: note = mRNA product Design2 comprising derived and/or modified sequence from DENV-1 CYD23__SSopt-prME(S186F) (CDS opt1)
  source 1..2425: mol_type = other RNA
ggggcgctgcctacggaggtggcagccatctccttctcggcatcaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcttcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2567 - RNA, 2425 nt, synthetic construct
  misc_feature 1..2425: note = mRNA product Design2 comprising derived and/or modified sequence from DENV-1 CYD23__SSopt-prME(R188L) (CDS opt1)
  source 1..2425: mol_type = other RNA
ggggcgctgcctacggaggtggcagccatctccttctcggcatcaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagccccctgacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2568 - RNA, 2425 nt, synthetic construct
  misc_feature 1..2425: note = mRNA product Design2 comprising derived and/or modified sequence from DENV-1 CYD23__SSopt-pr(D104A)MEdelstem_TM,(F108S)-JEV (CDS opt1)
  source 1..2425: mol_type = other RNA
ggggcgctgcctacggaggtggcagccatctccttctcggcatcaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgccaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgagcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2569 - RNA, 2425 nt, synthetic construct
  misc_feature 1..2425: note = mRNA product Design2 comprising derived and/or modified sequence from DENV-1 CYD23__SSopt-prMEdelstem_TM,(H261N)-JEV (CDS opt1)
  source 1..2425: mol_type = other RNA
ggggcgctgcctacggaggtggcagccatctccttctcggcatcaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgaacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2570 - RNA, 2425 nt, synthetic construct
  misc_feature 1..2425: note = mRNA product Design2 comprising derived and/or modified sequence from DENV-1 CYD23__SSopt-prMEdelstem_TM,(R188L,A267T)-JEV (CDS opt1)
  source 1..2425: mol_type = other RNA
ggggcgctgcctacggaggtggcagccatctccttctcggcatcaagcttaccatgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagccccctgacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacggggaccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2571 - RNA, 2413 nt, synthetic construct
  misc_feature 1..2413: note = mRNA product Design2 comprising derived and/or modified sequence from DENV-2 CYD2-T__SSc-prME (CDS opt1) R3545/R3546
  source 1..2413: mol_type = other RNA
ggggcgctgcctacggaggtggcagccatctccttctcggcatcaagcttaccatgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2572 - RNA, 2413 nt, synthetic construct
  misc_feature 1..2413: note = mRNA product Design2 comprising derived and/or modified sequence from DENV-2 CYD2-T__SSc-prME(F108S) (CDS opt1)
  source 1..2413: mol_type = other RNA
ggggcgctgcctacggaggtggcagccatctccttctcggcatcaagcttaccatgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctctccgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2573 - RNA, 2413 nt, synthetic construct
  misc_feature 1..2413: note = mRNA product Design2 comprising derived and/or modified sequence from DENV-2 CYD2-T__SSc-prMEdelstem_TM-JEV (CDS opt1) R3547/R3548
  source 1..2413: mol_type = other RNA
ggggcgctgcctacggaggtggcagccatctccttctcggcatcaagcttaccatgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2574 - RNA, 1714 nt, synthetic construct
  misc_feature 1..1714: note = mRNA product Design2 comprising derived and/or modified sequence from DENV-2 CYD2-T__SSm-EdelTM (CDS opt1) R3549/R3550
  source 1..1714: mol_type = other RNA
ggggcgctgcctacggaggtggcagccatctccttctcggcatcaagcttaccatgttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2575 - RNA, 2761 nt, synthetic construct
  misc_feature 1..2761: note = mRNA product Design2 comprising derived and/or modified sequence from DENV-2 CYD2-T__C-P2A-SSc-prME (CDS opt1) R3783/R3784
  source 1..2761: mol_type = other RNA
ggggcgctgcctacggaggtggcagccatctccttctcggcatcaagcttaccatgaacaaccagcgcaagaaggccaagaacaccccgttcaacatgctgaagcgggagcgcaaccgggtgagcaccgtccagcagctcacgaagcgcttctccctgggcatgctgcaggggcggggccccctcaagctgttcatggccctggtggcgttcctccgcttcctgaccatcccgcccaccgccgggatcctgaagcggtggggcaccatcaagaagagcaaggccatcaacgtgctccgcgggttccggaaggagatcggccgcatgctgaacatcctgaaccggcgccggcgcaacttcgacctgctcaagctggccggcgacgtggagagcaaccccgggccgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2576 - RNA, 2425 nt, synthetic construct
  misc_feature 1..2425: note = mRNA product Design2 comprising derived and/or modified sequence from DENV-2 CYD2-T__SSopt-prME(F108S) (CDS opt1)
  source 1..2425: mol_type = other RNA
ggggcgctgcctacggaggtggcagccatctccttctcggcatcaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctctccgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2577 - RNA, 2425 nt, synthetic construct
  misc_feature 1..2425: note = mRNA product Design2 comprising derived and/or modified sequence from DENV-2 CYD2-T__SSopt-prME(M96H) (CDS opt1)
  source 1..2425: mol_type = other RNA
ggggcgctgcctacggaggtggcagccatctccttctcggcatcaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactcccacgtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2578 - RNA, 2425 nt, synthetic construct
  misc_feature 1..2425: note = mRNA product Design2 comprising derived and/or modified sequence from DENV-2 CYD2-T__SSopt-prME(S186F) (CDS opt1)
  source 1..2425: mol_type = other RNA
ggggcgctgcctacggaggtggcagccatctccttctcggcatcaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgcttcccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2579 - RNA, 2425 nt, synthetic construct
  misc_feature 1..2425: note = mRNA product Design2 comprising derived and/or modified sequence from DENV-2 CYD2-T__SSopt-prME(R188L) (CDS opt1)
  source 1..2425: mol_type = other RNA
ggggcgctgcctacggaggtggcagccatctccttctcggcatcaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgctgacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2580 - RNA, 2425 nt, synthetic construct
  misc_feature 1..2425: note = mRNA product Design2 comprising derived and/or modified sequence from DENV-2 CYD2-T__SSopt-pr(D104A)MEdelstem_TM,(F108S)-JEV (CDS opt1)
  source 1..2425: mol_type = other RNA
ggggcgctgcctacggaggtggcagccatctccttctcggcatcaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgccaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcagcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2581 - RNA, 2425 nt, synthetic construct
  misc_feature 1..2425: note = mRNA product Design2 comprising derived and/or modified sequence from DENV-2 CYD2-T__SSopt-prMEdelstem_TM,(H261N)-JEV (CDS opt1)
  source 1..2425: mol_type = other RNA
ggggcgctgcctacggaggtggcagccatctccttctcggcatcaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgaacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2582 - RNA, 2425 nt, synthetic construct
  misc_feature 1..2425: note = mRNA product Design2 comprising derived and/or modified sequence from DENV-2 CYD2-T__SSopt-prMEdelstem_TM,(R188L,A267T)-JEV (CDS opt1)
  source 1..2425: mol_type = other RNA
ggggcgctgcctacggaggtggcagccatctccttctcggcatcaagcttaccatgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgctgacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcaccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2583 - RNA, 2413 nt, synthetic construct
  misc_feature 1..2413: note = mRNA product Design2 comprising derived and/or modified sequence from DENV-4 Consensus__SSc-prME (CDS opt1) R3559/R3560
  source 1..2413: mol_type = other RNA
ggggcgctgcctacggaggtggcagccatctccttctcggcatcaagcttaccatgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2584 - RNA, 2413 nt, synthetic construct
  misc_feature 1..2413: note = mRNA product Design2 comprising derived and/or modified sequence from DENV-4 Consensus__SSc-prME(F108S) (CDS opt1)
  source 1..2413: mol_type = other RNA
ggggcgctgcctacggaggtggcagccatctccttctcggcatcaagcttaccatgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgtccgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2585 - RNA, 2413 nt, synthetic construct
  misc_feature 1..2413: note = mRNA product Design2 comprising derived and/or modified sequence from DENV-4 Consensus__SSc-prMEdelstem_TM-JEV (CDS opt1) R3561/R3562
  source 1..2413: mol_type = other RNA
ggggcgctgcctacggaggtggcagccatctccttctcggcatcaagcttaccatgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2586 - RNA, 1714 nt, synthetic construct
  misc_feature 1..1714: note = mRNA product Design2 comprising derived and/or modified sequence from DENV-4 Consensus__SSm-EdelTM (CDS opt1) R3563/R3564
  source 1..1714: mol_type = other RNA
ggggcgctgcctacggaggtggcagccatctccttctcggcatcaagcttaccatgatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2587 - RNA, 2758 nt, synthetic construct
  misc_feature 1..2758: note = mRNA product Design2 comprising derived and/or modified sequence from DENV-4 Consensus__C-P2A-SSc-prME (CDS opt1) R3787/R3788
  source 1..2758: mol_type = other RNA
ggggcgctgcctacggaggtggcagccatctccttctcggcatcaagcttaccatgaaccagcgcaagaaggtggtccggcccccgttcaacatgctgaagcgcgagcggaaccgcgtgagcaccccgcagggcctcgtgaagcggttctccaccgggctgttcagcggcaaggggcccctgcgcatggtcctcgccttcatcacgttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgcaacttcgacctgctcaagctggccggcgacgtggagagcaaccccgggccgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2588 - RNA, 2425 nt, synthetic construct
  misc_feature 1..2425: note = mRNA product Design2 comprising derived and/or modified sequence from DENV-4 Consensus__SSopt-prME(F108S) (CDS opt1)
  source 1..2425: mol_type = other RNA
ggggcgctgcctacggaggtggcagccatctccttctcggcatcaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgtccgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2589 - RNA, 2425 nt, synthetic construct
  misc_feature 1..2425: note = mRNA product Design2 comprising derived and/or modified sequence from DENV-4 Consensus__SSopt-prME(V96H) (CDS opt1)
  source 1..2425: mol_type = other RNA
ggggcgctgcctacggaggtggcagccatctccttctcggcatcaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgaccacgtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2590 - RNA, 2425 nt, synthetic construct
  misc_feature 1..2425: note = mRNA product Design2 comprising derived and/or modified sequence from DENV-4 Consensus__SSopt-prME(E186F) (CDS opt1)
  source 1..2425: mol_type = other RNA
ggggcgctgcctacggaggtggcagccatctccttctcggcatcaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcttcccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2591 - RNA, 2425 nt, synthetic construct
  misc_feature 1..2425: note = mRNA product Design2 comprising derived and/or modified sequence from DENV-4 Consensus__SSopt-prME(R188L) (CDS opt1)
  source 1..2425: mol_type = other RNA
ggggcgctgcctacggaggtggcagccatctccttctcggcatcaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagcccctgagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2592 - RNA, 2425 nt, synthetic construct
  misc_feature 1..2425: note = mRNA product Design2 comprising derived and/or modified sequence from DENV-4 Consensus__SSopt-pr(D104A)MEdelstem_TM,(F108S)-JEV (CDS opt1)
  source 1..2425: mol_type = other RNA
ggggcgctgcctacggaggtggcagccatctccttctcggcatcaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggccaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgagcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2593 - RNA, 2425 nt, synthetic construct
  misc_feature 1..2425: note = mRNA product Design2 comprising derived and/or modified sequence from DENV-4 Consensus__SSopt-prMEdelstem_TM,(H261N)-JEV (CDS opt1)
  source 1..2425: mol_type = other RNA
ggggcgctgcctacggaggtggcagccatctccttctcggcatcaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgaacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2594 - RNA, 2425 nt, synthetic construct
  misc_feature 1..2425: note = mRNA product Design2 comprising derived and/or modified sequence from DENV-4 Consensus__SSopt-prMEdelstem_TM,(R188L,A267T)-JEV (CDS opt1)
  source 1..2425: mol_type = other RNA
ggggcgctgcctacggaggtggcagccatctccttctcggcatcaagcttaccatgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagcccctgagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcaccaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2595 - RNA, 2407 nt, synthetic construct
  misc_feature 1..2407: note = mRNA product Design2 comprising derived and/or modified sequence from DENV-3 Consensus__SSc-prME (CDS opt1) R3551/R3552
  source 1..2407: mol_type = other RNA
ggggcgctgcctacggaggtggcagccatctccttctcggcatcaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2596 - RNA, 2407 nt, synthetic construct
  misc_feature 1..2407: note = mRNA product Design2 comprising derived and/or modified sequence from DENV-3 Consensus__SSc-prME(F108S) (CDS opt1) R3764/R3765
  source 1..2407: mol_type = other RNA
ggggcgctgcctacggaggtggcagccatctccttctcggcatcaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctctccgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2597 - RNA, 2407 nt, synthetic construct
  misc_feature 1..2407: note = mRNA product Design2 comprising derived and/or modified sequence from DENV-3 Consensus__SSc-prME(R186L) (CDS opt1) R3557/R3558
  source 1..2407: mol_type = other RNA
ggggcgctgcctacggaggtggcagccatctccttctcggcatcaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2598 - RNA, 2407 nt, synthetic construct
  misc_feature 1..2407: note = mRNA product Design2 comprising derived and/or modified sequence from DENV-3 Consensus__SSc-prME(A265T) (CDS opt1) R3779/R3780
  source 1..2407: mol_type = other RNA
ggggcgctgcctacggaggtggcagccatctccttctcggcatcaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2599 - RNA, 2407 nt, synthetic construct
  misc_feature 1..2407: note = mRNA product Design2 comprising derived and/or modified sequence from DENV-3 Consensus__SSc-prMEdelstem_TM-JEV (CDS opt1) R3553/R3554
  source 1..2407: mol_type = other RNA
ggggcgctgcctacggaggtggcagccatctccttctcggcatcaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2600 - RNA, 1708 nt, synthetic construct
  misc_feature 1..1708: note = mRNA product Design2 comprising derived and/or modified sequence from DENV-3 Consensus__SSm-EdelTM (CDS opt1) R3555/R3556
  source 1..1708: mol_type = other RNA
ggggcgctgcctacggaggtggcagccatctccttctcggcatcaagcttaccatgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2601 - RNA, 2755 nt, synthetic construct
  misc_feature 1..2755: note = mRNA product Design2 comprising derived and/or modified sequence from DENV-3 Consensus__C-P2A-SSc-prME (CDS opt1) R3785/R3786
  source 1..2755: mol_type = other RNA
ggggcgctgcctacggaggtggcagccatctccttctcggcatcaagcttaccatgaacaaccagcgcaagaagaccggcaagccgagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagagcggcgccatcaaggtcctgaaggggttcaagaaggagatctccaacatgctgagcatcatcaacaagcggaagaagaacttcgacctgctcaagctggccggcgacgtggagagcaaccccgggccgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2602 - RNA, 2419 nt, synthetic construct
  misc_feature 1..2419: note = mRNA product Design2 comprising derived and/or modified sequence from DENV-3 Consensus__SSopt-prME (CDS opt1)
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2603 - RNA, 2419 nt, synthetic construct
  misc_feature 1..2419: note = mRNA product Design2 comprising derived and/or modified sequence from DENV-3 Consensus__SSopt-prME(F108S) (CDS opt1) R4457/R4458
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2604 - RNA, 2419 nt, synthetic construct
  misc_feature 1..2419: note = mRNA product Design2 comprising derived and/or modified sequence from DENV-3 Consensus__SSopt-prME(H27N) (CDS opt1) R4471/R4472
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagaacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2605 - RNA, 2419 nt, synthetic construct
  misc_feature 1..2419: note = mRNA product Design2 comprising derived and/or modified sequence from DENV-3 Consensus__SSopt-prME(T76I) (CDS opt1) R4485/R4486
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccatccagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2606 - RNA, 2419 nt, synthetic construct
  misc_feature 1..2419: note = mRNA product Design2 comprising derived and/or modified sequence from DENV-3 Consensus__SSopt-prME(N89D) (CDS opt1) R4487/R4488
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccaggactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2607 - RNA, 2419 nt, synthetic construct
  misc_feature 1..2419: note = mRNA product Design2 comprising derived and/or modified sequence from DENV-3 Consensus__SSopt-prME(Y96H) (CDS opt1) R4489/R4490
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacccacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2608 - RNA, 2419 nt, synthetic construct
  misc_feature 1..2419: note = mRNA product Design2 comprising derived and/or modified sequence from DENV-3 Consensus__SSopt-prME(K110E) (CDS opt1) R4491/R4492
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcggggagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2609 - RNA, 2419 nt, synthetic construct
  misc_feature 1..2419: note = mRNA product Design2 comprising derived and/or modified sequence from DENV-3 Consensus__SSopt-prME(H149N) (CDS opt1) R4481/R4482
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagaaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2610 - RNA, 2419 nt, synthetic construct
  misc_feature 1..2419: note = mRNA product Design2 comprising derived and/or modified sequence from DENV-3 Consensus__SSopt-prME(S184F) (CDS opt1) R4483/R4484
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgcttcccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2611 - RNA, 2419 nt, synthetic construct
  misc_feature 1..2419: note = mRNA product Design2 comprising derived and/or modified sequence from DENV-3 Consensus__SSopt-prME(R186L) (CDS opt1) R4445/R4446
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2612 - RNA, 2419 nt, synthetic construct
  misc_feature 1..2419: note = mRNA product Design2 comprising derived and/or modified sequence from DENV-3 Consensus__SSopt-prME(N240S) (CDS opt1) R4493/R4494
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagagcgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2613 - RNA, 2419 nt, synthetic construct
  misc_feature 1..2419: note = mRNA product Design2 comprising derived and/or modified sequence from DENV-3 Consensus__SSopt-prME(M258L) (CDS opt1) R4495/R4496
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgctgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2614 - RNA, 2419 nt, synthetic construct
  misc_feature 1..2419: note = mRNA product Design2 comprising derived and/or modified sequence from DENV-3 Consensus__SSopt-prME(H259N) (CDS opt1) R4473/R4474
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgaacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2615 - RNA, 2419 nt, synthetic construct
  misc_feature 1..2419: note = mRNA product Design2 comprising derived and/or modified sequence from DENV-3 Consensus__SSopt-prME(H259R) (CDS opt1) R4477/R4478
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcgcacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2616 - RNA, 2419 nt, synthetic construct
  misc_feature 1..2419: note = mRNA product Design2 comprising derived and/or modified sequence from DENV-3 Consensus__SSopt-prME(A265T) (CDS opt1) R4447/R4448
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2617 - RNA, 2419 nt, synthetic construct
  misc_feature 1..2419: note = mRNA product Design2 comprising derived and/or modified sequence from DENV-3 Consensus__SSopt-prME(S296G) (CDS opt1) R4497/R4498
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgggctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2618 - RNA, 2419 nt, synthetic construct
  misc_feature 1..2419: note = mRNA product Design2 comprising derived and/or modified sequence from DENV-3 Consensus__SSopt-prME(S311R) (CDS opt1) R4499/R4500
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtccgcgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2619 - RNA, 2419 nt, synthetic construct
  misc_feature 1..2419: note = mRNA product Design2 comprising derived and/or modified sequence from DENV-3 Consensus__SSopt-prME(K321T) (CDS opt1) R4501/R4502
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaccgtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2620 - RNA, 2419 nt, synthetic construct
  misc_feature 1..2419: note = mRNA product Design2 comprising derived and/or modified sequence from DENV-3 Consensus__SSopt-prME(G28C,H242C) (CDS opt1) R4479/R4480
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcactgcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcctgcgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2621 - RNA, 2419 nt, synthetic construct
  misc_feature 1..2419: note = mRNA product Design2 comprising derived and/or modified sequence from DENV-3 Consensus__SSopt-prME(R186L,A265T) (CDS opt1) R4449/R4450
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2622 - RNA, 2419 nt, synthetic construct
  misc_feature 1..2419: note = mRNA product Design2 comprising derived and/or modified sequence from DENV-3 Consensus__SSopt-pr(D104A)ME(F108S) (CDS opt1) R4459/R4460
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2623 - RNA, 2419 nt, synthetic construct
  misc_feature 1..2419: note = mRNA product Design2 comprising derived and/or modified sequence from DENV-3 Consensus__SSopt-pr(D104A)ME(R186L,A265T) (CDS opt1) R4453/R4454
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2624 - RNA, 2419 nt, synthetic construct
  misc_feature 1..2419: note = mRNA product Design2 comprising derived and/or modified sequence from DENV-3 Consensus__SSopt-pr(D104A)ME(F108S,R186L,A265T) (CDS opt1) R4463/R4464
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2625 - RNA, 2398 nt, synthetic construct
  misc_feature 1..2398: note = mRNA product Design2 comprising derived and/or modified sequence from DENV-3 Consensus__SSopt-prMEdel101-107,(R99P,F108N) (CDS opt1) R4467/R4468
  source 1..2398: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccccgggaacgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2626 - RNA, 2419 nt, synthetic construct
  misc_feature 1..2419: note = mRNA product Design2 comprising derived and/or modified sequence from DENV-3 Consensus__SSopt-prMEdelstem_TM-JEV (CDS opt1)
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2627 - RNA, 2419 nt, synthetic construct
  misc_feature 1..2419: note = mRNA product Design2 comprising derived and/or modified sequence from DENV-3 Consensus__SSopt-pr(D104A)MEdelstem_TM,(F108S)-JEV (CDS opt1) R4461/R4462
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2628 - RNA, 2419 nt, synthetic construct
  misc_feature 1..2419: note = mRNA product Design2 comprising derived and/or modified sequence from DENV-3 Consensus__SSopt-pr(D104A)MEdelstem_TM,(R186L,A265T)-JEV (CDS opt1) R4455/R4456
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2629 - RNA, 2419 nt, synthetic construct
  misc_feature 1..2419: note = mRNA product Design2 comprising derived and/or modified sequence from DENV-3 Consensus__SSopt-pr(D104A)MEdelstem_TM,(F108S,R186L,A265T)- JEV (CDS opt1) R4465/R4466
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgcgaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2630 - RNA, 2419 nt, synthetic construct
  misc_feature 1..2419: note = mRNA product Design2 comprising derived and/or modified sequence from DENV-3 Consensus__SSopt-prMEdelstem_TM,(H259N)-JEV (CDS opt1) R4475/R4476
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgaacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2631 - RNA, 2419 nt, synthetic construct
  misc_feature 1..2419: note = mRNA product Design2 comprising derived and/or modified sequence from DENV-3 Consensus__SSopt-prMEdelstem_TM,(R186L,A265T)-JEV (CDS opt1) R4451/R4452
  source 1..2419: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2632 - RNA, 2398 nt, synthetic construct
  misc_feature 1..2398: note = mRNA product Design2 comprising derived and/or modified sequence from DENV-3 Consensus__SSopt-prMEdelstem_TM,del101-107,(R99P,F108N)-JEV (CDS opt1) R4469/R4470
  source 1..2398: mol_type = other RNA
ggggcgctgcctacggaggtggcagccatctccttctcggcatcaagcttaccatgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccccgggaacgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2633 - RNA, 3463 nt, synthetic construct
  misc_feature 1..3463: note = mRNA product Design2 comprising derived and/or modified sequence from DENV-3 Consensus__SSc-prME-NS1 (CDS opt1) R3789/R3790
  source 1..3463: mol_type = other RNA
ggggcgctgcctacggaggtggcagccatctccttctcggcatcaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2634 - RNA, 2206 nt, synthetic construct
  misc_feature 1..2206: note = mRNA product Design2 comprising derived and/or modified sequence from DENV-3 Consensus__SSm-EdelTM-linker-ferritin (CDS opt1) R3795/R3796
  source 1..2206: mol_type = other RNA
ggggcgctgcctacggaggtggcagccatctccttctcggcatcaagcttaccatgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccagcggcggggacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2635 - RNA, 2203 nt, synthetic construct
  misc_feature 1..2203: note = mRNA product Design2 comprising derived and/or modified sequence from DENV-3 Consensus__SStPA-WHbcAg-linker-EdelTM (CDS opt1) R3799/R3800
  source 1..2203: mol_type = other RNA
ggggcgctgcctacggaggtggcagccatctccttctcggcatcaagcttaccatggacgccatgaagcgcggcctgtgctgcgtgctcctgctgtgcggggccgtcttcgtggacagcgtgaccggcatggacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtgcgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgcggcgggggcgggagcggcgggggcggcatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2636 - RNA, 5887 nt, synthetic construct
  misc_feature 1..5887: note = mRNA product Design2 comprising derived and/or modified sequence from DENV-3 Consensus__SSc-prME-NS1-[IRES]-NS3 (CDS opt1) R3791/R3792
  source 1..5887: mol_type = other RNA
ggggcgctgcctacggaggtggcagccatctccttctcggcatcaagcttaccatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2637 - RNA, 5887 nt, synthetic construct
  misc_feature 1..5887: note = mRNA product Design2 comprising derived and/or modified sequence from DENV-3 Consensus__NS3-[IRES]- SSc-prME-NS1 (CDS opt1) R3793/R3794
  source 1..5887: mol_type = other RNA
ggggcgctgcctacggaggtggcagccatctccttctcggcatcaagcttaccatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggccgacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2638 - RNA, 4630 nt, synthetic construct
  misc_feature 1..4630: note = mRNA product Design2 comprising derived and/or modified sequence from DENV-3 Consensus__SSm-EdelTM-linker-ferritin-[IRES]-NS3 (CDS opt1) R3797/R3798
  source 1..4630: mol_type = other RNA
ggggcgctgcctacggaggtggcagccatctccttctcggcatcaagcttaccatgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccagcggcggggacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2639 - RNA, 4627 nt, synthetic construct
  misc_feature 1..4627: note = mRNA product Design2 comprising derived and/or modified sequence from DENV-3 Consensus__SStPA-WHbcAg-linker-EdelTM-[IRES]-NS3 (CDS opt1) R3801/R3802
  source 1..4627: mol_type = other RNA
ggggcgctgcctacggaggtggcagccatctccttctcggcatcaagcttaccatggacgccatgaagcgcggcctgtgctgcgtgctcctgctgtgcggggccgtcttcgtggacagcgtgaccggcatggacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtgcgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgcggcgggggcgggagcggcgggggcggcatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctgacccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatgagcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2640 - protein, 3292 aa, synthetic construct
  REGION 1..3292: note = derived and/or modified protein sequence (wt) from DENV-1__AB608789__SS-prME
SVTMLLMLMPTALAFHLTTRGGEPHMIVTKQERGKSLLFKTSAGVNMCTLIAMDLGELCEDTMTYKCPRITEAEPDDIDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKRGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCMSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTVSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDEGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGVKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAPESRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSSSELETPNLAERVLDWLGKYGVERLKRMAISGDDCVVKPIDDRFATALTALNDVGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLIGNENYLDYMTSMKRFKNESDPEGALW

SEQ ID NO: 2641 - protein, 3292 aa, synthetic construct
  REGION 1..3292: note = derived and/or modified protein sequence (wt) from DENV-1__AB608788__SS-prME
SVTMLLMLLPTVLAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGATTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRVITANPIVTDKEKPVNIEAEPPFGESYIVVGAGEKALKLSWFKKGSTIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGYVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTSGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWAALLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGAGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVRLLTKPWDVIPMVTQIAMTDTTPFGQQRVFKEKVDTRTPKAKQGTAQVMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHRLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTENMLSVWNRVWIEENPWMEDKTHVSSWEDVPYLGKREDQWCGSLIGLTARATWATNIQVAINQVRRLIGNENYLDYMTSMKRFKNDSDPEGALW

SEQ ID NO: 2642 - protein, 3292 aa, synthetic construct
  REGION 1..3292: note = derived and/or modified protein sequence (wt) from DENV-1__AB608786__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSLAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKGSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2643 - protein, 3292 aa, synthetic construct
  REGION 1..3292: note = derived and/or modified protein sequence (wt) from DENV-1__AB608787__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIVHEWCCRSCTLPPLRFRGEDGCWYGMEIRPVKEKEENLVKSMVSAGSGEVDSFSLGLLCISIIIEEVMRSRWIRKMLMTGTLGVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKGSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARPTWATNIQVAINQVRRLIGNENYLDYMTSMKRFKNESEPEGALW

SEQ ID NO: 2644 - protein, 3292 aa, synthetic construct
  REGION 1..3292: note = derived and/or modified protein sequence (wt) from DENV-1__HE795086__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGVRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQDGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKYEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2645 - protein, 3292 aa, synthetic construct
  REGION 1..3292: note = derived and/or modified protein sequence (wt) from DENV-1__AB189120__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEAVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLEELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWYFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGTERLRRMAISGDDCVVKPIDDRFATALTALNDMGKIRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2646 - protein, 3292 aa, synthetic construct
  REGION 1..3292: note = derived and/or modified protein sequence (wt) from DENV-1__AB189121__SS-prME
SVTMLFMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVMALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTAIITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVIQNGRLITANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNITFIIDGPNTSECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPVSQHNYRPGYFTQTAGPWHLGKLELDFDLCEGTTVVVDENCGNRGPSLRTTTVTGKTIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDMMGMGTTYLALMATFRMRPMFAVGLLFRRLTSREVLLLTVGLSLVASVELPNSLEELGDGLAMGIMMLKLLTDFQPHQLWATLLSLTFVKTTFSLHYAWKTMAMILSIVSLLPLCLSTTSQKTTWLPVLLGSLGCKPLTMLLITENKIWGRRSWPLNEGIMAIGIVSILLSSLLKNDVPLAGPLIAGGMLIACYVISGSSADLSLEKAAEVSWEDEAEHSGASHNILVEVQDDGTMKIKDEERDDTLTILLKATLLAISGVYPMSIPATLFVWYFWQKKKQRSGVLWDTPSPPEVERAVLDNGIYRILQRGLLGRSQVGVGVFQEGVFHTMWHVTRGAVLMYQGKRLEPSWASVKRDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYEWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNPNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEKMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVFDWLEKHGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2647 - protein, 3292 aa, synthetic construct
  REGION 1..3292: note = derived and/or modified protein sequence (wt) from DENV-1__AB195673__SS-prME
SVTMLLMLLPTALTFHLTTRGGEPHMIVGKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHVIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKSIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDNMGMGTTYLALMATFRMRPMFAVGLLFRRLTSREVLLLTVGLSLVASVELPNSLEELGDGLAMGIMILKLLTDFQSHQLWATLLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEIQDDGTMKIKDEERDDTITILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIVEVDRSEAKEGLKRGETIKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMGAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2648 - protein, 3292 aa, synthetic construct
  REGION 1..3292: note = derived and/or modified protein sequence (wt) from DENV-1__AB204803__SS-prME
SVTMLLMLLPTVLTFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCVKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGPFKLEKEVAETQHGTVLVQVKYEGTDAPCKIPFSSQDEKGVTQNGRLITANPIVTDKEKPINIEAEPPFGESYIVVGVGEKALKLSWFKKGSSIGKMFEATARGARRMAILGDTAWDFGSIGGVFTSMGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECSDDQRAWNIWEVEDYGFGIFTTNIWLKLRDSYTQVCDHRLMSAAIKDSRAVHADMGYWIESEKNETWKLARASFIEVKTCIWPKSHTLWSNGVLESEMIIPKIYGGPISQHNYRPGYFTQTAGPWHLGKLELDFDLCEGTTVVVDEQCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDKMGMGTTYLALMATFRMRPMFAVGLLFRGLTSREVLLLTVGLSLVASVELPNSLEELGDGLAMGIMMLKLLTDFQSHQLWATLLSLTFVKTTFSLHYAWKTMAMTLSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTITILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQTALDNLVMLHNSEQGGKAYRHAMEELPDTIETLMLLALIAVLTGGVTLFFLSGKGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVRPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEAQLIRQMESEGIFSPSELETPNLAGRVLDWLEKHGIERLKRMAISGDDCVVKPIDDRFATALTALNDMGKVRKDIPQWEPSKGWNDWQQVPFCSHHFHQLIMKDGREIVVPCRSQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2649 - protein, 3292 aa, synthetic construct
  REGION 1..3292: note = derived and/or modified protein sequence (wt) from DENV-1__LC016760__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTIAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMKDKTHISSWEDVPYLGKREDQWCGSLIGLTARATWATNIQVAINQVRRLIGNENYLDYMTSMKRFKNESDPEGALW

SEQ ID NO: 2650 - protein, 3292 aa, synthetic construct
  REGION 1..3292: note = derived and/or modified protein sequence (wt) from DENV-1__LC128301__SS-prME
SVTMLLMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGILAQGKKMIRPQPMEHKYSWKSWGKAKVIGADVQNTTFIIDGPNTPECPDDQRAWNIWEVEDYGFGIFTTNIWLKLRDSYTQVCDHRLMSAAIKDSKAVHADMGYWIESEKNETWKLTRASFIEVKTCIWPKSHTLWSNGVLESEMIIPKTYGGPISQHNYRPGYFTQTAGPWHLGKLELDFGLCEGTTVVVDEHCGNRGPSLRTTTVTGKIIHEWCCRSCTLPPLRFKGEDGCWYGMEIRPVKEKEENLVRSMVSAGSGEVDSFSLGLLCISIMIEEVMRSRWSRKMLMTGTLAVFLLLIMGQLTWNDLIRLCIMVGANASDKMGMGTTYLALMATFRMRPMFAVGLLFRRLTSREVLLLTVGLSLVASVELPNSLEELGDGLAMGIMMLKLLTDFQSHQLWAALLSLTFVKTTFSLHYAWKTMAMILSIISLFPLCMSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAESHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMTHRKPTYEKDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGTERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2651 - protein, 3292 aa, synthetic construct
  REGION 1..3292: note = derived and/or modified protein sequence (wt) from DENV-1__LC011945__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTIAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGSERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMKDKTHISSWEDVPYLGKREDQWCGSLIGLTARATWATNIQVAINQVRRLIGNENYLDYMTSMKRFKNESDPEGALW

SEQ ID NO: 2652 - protein, 3292 aa, synthetic construct
  REGION 1..3292: note = derived and/or modified protein sequence (wt) from DENV-1__LC011949__SS-prME
SVTMLLMLVPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADTGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2653 - protein, 3292 aa, synthetic construct
  REGION 1..3292: note = derived and/or modified protein sequence (wt) from DENV-1__HM469966__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVVLAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWIASVEPHWIAASIILEFFLMVLLIPEPDRQRTPQDNQLAYVVIGLLFMILTVAANEMGLLETTKKDLGIGHVAVENHHHAAILDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWKGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2654 - protein, 3292 aa, synthetic construct
  REGION 1..3292: note = derived and/or modified protein sequence (wt) from DENV-1__JX669462__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATLKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2655 - protein, 3292 aa, synthetic construct
  REGION 1..3292: note = derived and/or modified protein sequence (wt) from DENV-1__JX669463__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATLKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2656 - protein, 3292 aa, synthetic construct
  REGION 1..3292: note = derived and/or modified protein sequence (wt) from DENV-1__JX669464__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKIPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2657 - protein, 3292 aa, synthetic construct
  REGION 1..3292: note = derived and/or modified protein sequence (wt) from DENV-1__JX669465__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADTQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKTYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKIRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2658 - protein, 3292 aa, synthetic construct
  REGION 1..3292: note = derived and/or modified protein sequence (wt) from DENV-1__JX669466__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTILVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADLGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2659 - protein, 3292 aa, synthetic construct
  REGION 1..3292: note = derived and/or modified protein sequence (wt) from DENV-1__JX669467__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2660 - protein, 3292 aa, synthetic construct
  REGION 1..3292: note = derived and/or modified protein sequence (wt) from DENV-1__HM469967__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEIGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNSDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWKGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLKWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRKNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQKVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2661 - protein, 3292 aa, synthetic construct
  REGION 1..3292: note = derived and/or modified protein sequence (wt) from DENV-1__JX669468__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGNGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2662 - protein, 3292 aa, synthetic construct
  REGION 1..3292: note = derived and/or modified protein sequence (wt) from DENV-1__JX669469__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIKAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMAQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATILDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2663 - protein, 3292 aa, synthetic construct
  REGION 1..3292: note = derived and/or modified protein sequence (wt) from DENV-1__JX669470__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIVVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYLWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLRNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2664 - protein, 3292 aa, synthetic construct
  REGION 1..3292: note = derived and/or modified protein sequence (wt) from DENV-1__JX669471__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATLKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTVPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYDRDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2665 - protein, 3292 aa, synthetic construct
  REGION 1..3292: note = derived and/or modified protein sequence (wt) from DENV-1__JX669472__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGNANGILAQGKKMIKPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2666 - protein, 3292 aa, synthetic construct
  REGION 1..3292: note = derived and/or modified protein sequence (wt) from DENV-1__JX669473__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPSSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGNANGILAQGKKMIKPQPMEHKYSWKSWGKAKIIGADIQNATFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2667 - protein, 3292 aa, synthetic construct
  REGION 1..3292: note = derived and/or modified protein sequence (wt) from DENV-1__JX669474__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGNANGILAQGKKMIKPQPMEHKYSWKSWGKAKIIGADIQNATFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPTSQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2668 - protein, 3292 aa, synthetic construct
  REGION 1..3292: note = derived and/or modified protein sequence (wt) from DENV-1__JX669475__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLSFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2669 - protein, 3292 aa, synthetic construct
  REGION 1..3292: note = derived and/or modified protein sequence (wt) from DENV-1__JX669461__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFLLLIMGQLTWNDLIRLCIMVGANASDKMGMGTTYLALMATLKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2670 - protein, 3292 aa, synthetic construct
  REGION 1..3292: note = derived and/or modified protein sequence (wt) from DENV-1__KF184975__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTEDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSIQDEKGVIQNGRLITANPIVTDKEKPVNIETEPPFGESYIVVGAGEKTLKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVNGILAQGKKMVRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDNFSLGLLCVSIMVEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQSHQLWTTLLSLTFVKTTLSLDYAWKTMAMVLSIVSLFPLCLSTTSQKTTWLPVLLGSFGCKPLTMFLITENKIWGRKSWPLNEGIMAVGIASILLSSLLKNDVPLAGPLIAGGMLIACYVISGSSADLSLEKAAEVSWEEEAEHSGASHNILVEVQDDGTMKIKDEERDDTLTILLKATLLAVSGVYPMSIPATLFVWYFWQKKKQRSGVLWDTPSPPEAEKAVLDDGIYRILQRGLLGRSQVGVGVFQDGVFHTMWHVTRGAVLMYQGKRVEPSWASVKKDLISYGGGWRFQGLWNTGEEVQVIAVEPGKNPRNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKTEHTGREIVDLMCHATFTMRLLSPVRVPNYNMIIMDEAHFTDPASIAARGYISTRVGMGEAAAIFMTATPPGSMEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGRLPQHLTLKAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFIILTVAANEMGLLETTKKDLGIGHVAAEDHQHATMLDVDLRPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGITEVDRSEAKEGLKRGETTKHAVSRGAAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAERALDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2671 - protein, 3292 aa, synthetic construct
  REGION 1..3292: note = derived and/or modified protein sequence (wt) from DENV-1__KT831765__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGMLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVTVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2672 - protein, 3292 aa, synthetic construct
  REGION 1..3292: note = derived and/or modified protein sequence (wt) from DENV-1__KP188567__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIKPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANALDRMGMGTTYLALMATFKMRPMFAVGLLFRRLTSREVLLLTVGLSLVASVELPSSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGTLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPADWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2673 - protein, 3292 aa, synthetic construct
  REGION 1..3292: note = derived and/or modified protein sequence (wt) from DENV-1__KP188568__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFFLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPSIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAAIQDEERDIPERSWNTGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWVASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSVMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2674 - protein, 3292 aa, synthetic construct
  REGION 1..3292: note = derived and/or modified protein sequence (wt) from DENV-1__KF971870__SS-prME
SVTMLLMLMPTALAFHLTTRGGEPHMMVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSSAIKDSKAVHADMGYWIESEKNDTWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVFPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGEREKLRPRWLGARTYSDPLALRDFKEFAAGRRSVSGDLILEIGKLPQHLTQRAQNALDNLVMLHNSQQGGRAYTHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRRLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWEDVPYLGKREDQWCGSLIGLTARATWATNIQVAINQVRRLIGNENYLDYMTSMKRFKNESDPEGALW

SEQ ID NO: 2675 - protein, 3292 aa, synthetic construct
  REGION 1..3292: note = derived and/or modified protein sequence (wt) from DENV-1__KF971871__SS-prME
SVTMLLMLMPTALAFHLTTRGGEPHMMVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNDTWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVFPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLGARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRRLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWEDVPYLGKREDQWCGSLIGLTARATWATNIQVAINQVRRLIGNENYLDYMTSMKRFKNESDPEGALW

SEQ ID NO: 2676 - protein, 3292 aa, synthetic construct
  REGION 1..3292: note = derived and/or modified protein sequence (wt) from DENV-1__KF971869__SS-prME
SVTMLLMLMPTALAFHLTTRGGEPHMMVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNDTWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVFPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRRLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWEDVPYLGKREDQWCGSLIGLTARATWATNIQVAINQVRRLIGNENYLDYMTSMKRFKNESDPEGALW

SEQ ID NO: 2677 - protein, 3292 aa, synthetic construct
  REGION 1..3292: note = derived and/or modified protein sequence (wt) from DENV-1__JN903578__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKVVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLIQDEKGVTQNGRLITANPIVTDKEKPVNIETEPPFGESYIVVGAGEKALKLSRFKKGSSIGKMFEATARGARRMAILGDTAWDFGSIGGVFTSVGKLIHQVFGTAYGVLFSGVSWTMKIGIGILLTWLGLNSRSTSLSMTCITVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEIKTCIWPKSHTLWSNGVLESEMIIPKIYGGPISQHNHRPGYFTQTAGPWHLGKLELDFDVCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASAELPNSLEELGDGLAMGIMMLKLLTDFQSHQLWTTLLSLTFIKTTLSLDYAWKTITMILSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDGDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGSRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTTMKRFKNESDPEGALW

SEQ ID NO: 2678 - protein, 3292 aa, synthetic construct
  REGION 1..3292: note = derived and/or modified protein sequence (wt) from DENV-1__JN903579__SS-prME
SVTMLLMLLPTALAFHLTTRGGEPHMIVGKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADTGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASAELPNSLEELGDGLAMGIMMLKLLTDFQSHQLWTTLLSLTFIKTTLSLDYAWKTIAMILSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTIDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGSLFMILTVAANEMGLLETTKKDLGIGHVVAENHHHATTLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLYKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYSDYTTSMKRFKNESDPEGALW

SEQ ID NO: 2679 - protein, 3292 aa, synthetic construct
  REGION 1..3292: note = derived and/or modified protein sequence (wt) from DENV-1__JN903580__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRNTSLSMTCIAVGMVTLYLGVMVQADTGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMKSRWSRKMLMTGTLAVFFLLIMGQLTWNDLIRLCIMVGANVSDRMGMGTTYLALMATFKMRPMFAVGLLFRRLTSREVLLLTIGLSLVASAELPNSLEELGDGLAMGIMMLKLLTDFQSHQLWTTLLSLTFIKTTLSLDYAWKTIAMILSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQDGVFRTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRDTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRMENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLYKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYSDYMTSMKRFKNESDPEGALW

SEQ ID NO: 2680 - protein, 3292 aa, synthetic construct
  REGION 1..3292: note = derived and/or modified protein sequence (wt) from DENV-1__JN903581__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRNTSLSMTCIAVGMVTLYLGVMVQADTGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGIFTTNIWLKLRDSYTQMCDHRLMSAVIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEEEENLVRSMVSAGSGEVDSFSLGLLCVSIMIEEVMKSRWSRKMLMTGTLAVFFLLIMGQLTWNDLIRLCIMVGANVSDRMGMGTTYLALMATFKMRPMFAVGLLFRRLTSREVLLLTIGLSLVASAELPNSLEELGDGLAMGIMMLKLLADFQSHQLWTTLLSLTFIKTTLSLDYAWKTIAMILSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGDGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLEPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKRDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTVKLRWFVERNLVKPEGKVIDLGCGRGGWSYYCAGLKKVTEVKGYTKGGPGHEEPIPMATYGWNIVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLYKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYSDYMTSMKRFKNESDPEGALW

SEQ ID NO: 2681 - protein, 3292 aa, synthetic construct
  REGION 1..3292: note = derived and/or modified protein sequence (wt) from DENV-1__KX380796__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQMQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKTVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFNGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQPHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2682 - protein, 3292 aa, synthetic construct
  REGION 1..3292: note = derived and/or modified protein sequence (wt) from DENV-1__KX380799__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2683 - protein, 3292 aa, synthetic construct
  REGION 1..3292: note = derived and/or modified protein sequence (wt) from DENV-1__KX380800__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAIFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2684 - protein, 3292 aa, synthetic construct
  REGION 1..3292: note = derived and/or modified protein sequence (wt) from DENV-1__KX380802__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMGKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2685 - protein, 3292 aa, synthetic construct
  REGION 1..3292: note = derived and/or modified protein sequence (wt) from DENV-1__KX380797__SS-prME
SVTVLLMLLPTALAFHLTTRGGEPHMIVSKQERGKSLLFKTSTGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTLVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFTSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGILAQGKKMIRPQPMEHKYSWKSWGKAKVIGADVQNSTFIIDGPNTPECPDDQRAWNIWEVEDYGFGIFTTNIWLKLRDSYTQVCDHRLMSAAIKDSKAVHADMGYWIESEKNETWKLTRASFIEVKTCVWPKSHTLWSNGVLESEMIIPKIYGGPISQHNYRPGYFTQTAGPWHLGKLELDFGLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDKMGMGTTYLALMATFRMRPMFAVGLLFRRLTSREVLLRSVGLSLVASVELPNSLEELGDGLAMGIMMLKLLTDFQSHQLWAALLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAESHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLTKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGIERLKRMAISGDDCVVKPVDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2686 - protein, 3292 aa, synthetic construct
  REGION 1..3292: note = derived and/or modified protein sequence (wt) from DENV-1__KX380805__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLSVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2687 - protein, 3292 aa, synthetic construct
  REGION 1..3292: note = derived and/or modified protein sequence (wt) from DENV-1__KX380798__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2688 - protein, 3292 aa, synthetic construct
  REGION 1..3292: note = derived and/or modified protein sequence (wt) from DENV-1__KJ649286__SS-prME
SVTMLLMLLPTVLAFHLTTRGGEPHMIVTKQERGKSLLFKTSTGVNMCTLIAMDLGELCEDTMTYKCPRITEAEPDDIDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGATTSQETWNRQDLLVTFKTAHAKKQEVVVLGSQEGAMHTALTGATEIQTSGTTTIFAGHLKCRLKMDKLTLKGMSYVMCTGSFKLEKEVVETQHGTVLVQVKYEGTDAPCKIPFLTQDEKGVTQNGRVITANPIVTDKEKPVNIEAEPPFGESYIVVGAGEKALKLSWFKKGSTIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWAALLSLTFIKTTCSLHYAWKTMAMVLSIVSLFPLCMSTTSQKTTWLPVLLGSLGCKPLTMFLIAENKIWGRKSWPLNEGIMAVGIVSILLSSLLKNDVPLAGPLVAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYKGKRLEPTWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQSALDNLVMLHNSEQGGRAYRHAMEELPDTIETLMLLALIAVLTGGVTLFFLSGKGLGKTSIGLLCVMASSMLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPMTLTAAVLMLVAHYTIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGAGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVRLLTKPWDVIPMVTQIAMTDTTPFGQQRVFKEKVDTRTPKAKRGTAQVMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHRLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGLFSPSELETPNLAERVLNWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTENMLSVWNRVWIEENPWMEDKTHVSSWEDVPYLGKREDQWCGSLIGLTARATWATNIQVAINQVRKLIGNENYLDYMTSMKRFKNDSDPEGALW

SEQ ID NO: 2689 - protein, 3292 aa, synthetic construct
  REGION 1..3292: note = derived and/or modified protein sequence (wt) from DENV-1__KF887994__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMLEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIIGQLTWNDLIRLCIMVGANASDRMGMGTTYLALMATFKMRPMFAVGLLFRRLTSREVLLLTIGLSLMASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWYYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEARITDIMEPEHALLAKSIFKLTYQNKVVRVQRPAKNGTVMDVVSRRDQRGSGQVGTYGLNTFTNMEAQLIRQMESEGIFSPSELETPNLAERVLAWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWIPTSRTTWSIHAHHQWMTTEDMLSVWNRVWIEENPWMEDKTHISSWGDVPYLGKREDQWCGSLIGLTARATWATNIQVAINQVRKLIGNENYLDYMTSMKRFKNESDPEGALW

SEQ ID NO: 2690 - protein, 3292 aa, synthetic construct
  REGION 1..3292: note = derived and/or modified protein sequence (wt) from DENV-1__JQ675358__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKTYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSLLLSSLLKNDVPLAGPLIAGGMLIACYVISGSSADLSLEKAAEVSWEQEAEHSGTSHNILVEVQDDGTMKIKDEERDDTLTILVKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPRKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSVGGGRRGMGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLHTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2691 - protein, 3292 aa, synthetic construct
  REGION 1..3292: note = derived and/or modified protein sequence (wt) from DENV-1__FJ850070__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAASGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKSSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2692 - protein, 3292 aa, synthetic construct
  REGION 1..3292: note = derived and/or modified protein sequence (wt) from DENV-1__FJ850071__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFFLLIMGQLTWNDLIRLCIMVGANASDRMGMGTTYLALMATFKMRPMFAVGLLFRKLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2693 - protein, 3292 aa, synthetic construct
  REGION 1..3292: note = derived and/or modified protein sequence (wt) from DENV-1__FJ850073__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNADGILAQGKKMIRPQPMEHKYSWKSWGKAKIIGADIQNTTFIIDGPDTLECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPVSQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGVLCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEVEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALMAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLRNEAKITDIMEPEHALLATSIFKLTYQNKVVRVQRPAKNGTVMDVISRRDQRGSGQVGTYGLNTFTNMEVQLIRQMESEGIFFSSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNGNYLDYMTSMKRFKNESDPEGALW

SEQ ID NO: 2694 - protein, 3292 aa, synthetic construct
  REGION 1..3292: note = derived and/or modified protein sequence (wt) from DENV-1__FJ850075__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKTIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2695 - protein, 3292 aa, synthetic construct
  REGION 1..3292: note = derived and/or modified protein sequence (wt) from DENV-1__FJ850077__SS-prME
SVTMLLMLLPTALAFHLTTRGGEPHMIVSKQERGKSLLFKTSVGVNMCTLIAMDLGELCEDTMTYKCPRITEVEPDDVDCWCNATDTWVTYGTCSQTGEHRRDKRSVALAPHVGLGLETRTETWMSSEGAWKQVQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRKLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENRIWGRKSWPINEGVMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTATVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGRDIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2696 - protein, 3292 aa, synthetic construct
  REGION 1..3292: note = derived and/or modified protein sequence (wt) from DENV-1__FJ850081__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSAEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2697 - protein, 3292 aa, synthetic construct
  REGION 1..3292: note = derived and/or modified protein sequence (wt) from DENV-1__FJ850084__SS-prME
SVTMLLMLLPTALAFHLTTRGGEPHMIVSKQERGKSLLFKTSVGVNMCTLIAMDLGELCEDTMTYKCPRITEVEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSAEVDSFSLGILCVSILIEEVMRSRWSRKMLMTGTLAVFLLLIMGQLTWNDLIRLCIMVGANASDRMGMGTTYLALMATFKMRPMFAVGLLFRKLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTATVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGRDIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2698 - protein, 3292 aa, synthetic construct
  REGION 1..3292: note = derived and/or modified protein sequence (wt) from DENV-1__FJ850087__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLVVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVLQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2699 - protein, 3292 aa, synthetic construct
  REGION 1..3292: note = derived and/or modified protein sequence (wt) from DENV-1__FJ850090__SS-prME
SVTMLLMLLPTALAFHLTTRGGEPHMIVSKQERGKSLLFKTSVGVNMCTLIAMDLGELCEDTMTYKCPRITEVEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVIQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRKLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTATVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWDFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGRDIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2700 - protein, 3292 aa, synthetic construct
  REGION 1..3292: note = derived and/or modified protein sequence (wt) from DENV-1__FJ850093__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLMASMELPNSLEELGDGLAMGIMMLKLLTEFQPHQLWTTLLSLTFVKTTLSLDYAWKTTAMILSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSETTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKRVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2701 - protein, 3292 aa, synthetic construct
  REGION 1..3292: note = derived and/or modified protein sequence (wt) from DENV-1__GU131863__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDINGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2702 - protein, 3292 aa, synthetic construct
  REGION 1..3292: note = derived and/or modified protein sequence (wt) from DENV-1__GQ868559__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2703 - protein, 3292 aa, synthetic construct
  REGION 1..3292: note = derived and/or modified protein sequence (wt) from DENV-1__GQ868560__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASIKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYIDYMTSMKRFKNESDPEGALW

SEQ ID NO: 2704 - protein, 3292 aa, synthetic construct
  REGION 1..3292: note = derived and/or modified protein sequence (wt) from DENV-1__GQ868561__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPSPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQTKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2705 - protein, 3292 aa, synthetic construct
  REGION 1..3292: note = derived and/or modified protein sequence (wt) from DENV-1__GU131948__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREILLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGIFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDTPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2706 - protein, 3292 aa, synthetic construct
  REGION 1..3292: note = derived and/or modified protein sequence (wt) from DENV-1__GQ868562__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQHENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGATLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2707 - protein, 3292 aa, synthetic construct
  REGION 1..3292: note = derived and/or modified protein sequence (wt) from DENV-1__GQ868563__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNATFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGLWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYAAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVPNLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2708 - protein, 3292 aa, synthetic construct
  REGION 1..3292: note = derived and/or modified protein sequence (wt) from DENV-1__GQ868564__SS-prME
SVTMLLMLLPTALAFHLTTRGGEPHMIVSKQERGKALLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEREENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEHEAEHSGASHNILVEVQDDGTMKIKDEERDDTLTILLKAALLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2709 - protein, 3292 aa, synthetic construct
  REGION 1..3292: note = derived and/or modified protein sequence (wt) from DENV-1__GQ868565__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNATFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGLWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYAAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2710 - protein, 3292 aa, synthetic construct
  REGION 1..3292: note = derived and/or modified protein sequence (wt) from DENV-1__GQ868568__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWIMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADTQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2711 - protein, 3292 aa, synthetic construct
  REGION 1..3292: note = derived and/or modified protein sequence (wt) from DENV-1__GQ868569__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVANPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNATFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGLWNMGEEVQVIAVEPGKNPRNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYAAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2712 - protein, 3292 aa, synthetic construct
  REGION 1..3292: note = derived and/or modified protein sequence (wt) from DENV-1__GQ868570__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKVGIGILLTWLGLNSRSTSLSMTCIAVGMVTLYLGVMVQADLGCVINWKGRELKCGSGIFVTNEVHTWTEQYKFQADSPKRLSAAIGKAWEEGVCGIRSVTRLENIMWKQISNELNHILLENDMKFTVVVGDANGILAQGKKMIRPQPMEHKYSWKSWGKAKIIGADTQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDKQRTPQDNQLAYVVIGLLFMILAVAANEMGLLETTKKDLGIGYVATENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFAAALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2713 - protein, 3292 aa, synthetic construct
  REGION 1..3292: note = derived and/or modified protein sequence (wt) from DENV-1__KJ189302__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPSPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2714 - protein, 3292 aa, synthetic construct
  REGION 1..3292: note = derived and/or modified protein sequence (wt) from DENV-1__KJ189303__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADTQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2715 - protein, 3292 aa, synthetic construct
  REGION 1..3292: note = derived and/or modified protein sequence (wt) from DENV-1__KR028435__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVICTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEEGGISERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2716 - protein, 3292 aa, synthetic construct
  REGION 1..3292: note = derived and/or modified protein sequence (wt) from DENV-1__JQ922548__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHTIGTSITQKGIIFILLMLVTPSMAMRCVGIGNRDFVEGLSGATWVDVVLEHGSCVTTMARNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPMSEIQLTDYGALTLDCSPRTGLDFNEMVLLTMKEKSWLVHKQWFLDLPLPWTSGASTSQETWNRQDLLVTFKTAQAKKQEVVVLGSQEGAMHTALTGATEIQTSGTTTMFAGHLKCRLKMDKLTLKGASYVMCTGPFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGAFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADAQNTTFIIDGPDTPECPDDQRAWNIWEVEDYGFGIFTTNIWLKLRDSYTQMCDHRLMSAAIKDSKAVHADMGYWIESEKNETWKLTRASFIEVKTCTWPRSHTLWSNGVLESEMIIPKIYGGPISQHNYRPGYFTQTAGPWHLGKLELDFNLCEGTTVVVDEHCGNGGASLGTTTVTGKIIHEWCCRSCTLPPLRFLGEDGCWYGMEIRPVKEKEENLFRSMVSAGSGEVDSFSLGLLCVSIMIEEVMRSRWSRKMLMTGTLAVFFLLIMGQLTWNDLIRLCIMVGANASDRIGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTIAMVLSIVSLFPLCLSTTSQKTTWLPVLLGSFGSKPLTMFLITENKIWGRKSWPLNEGIMAVGIVSILLSSLPKNDVPLAGPLIAGGMLIACYVISGSSADLSLERAAEVSWEEEAEHSGASHNILVEVQDDGNMKIKDEERDDSLTILLKATLLAVSGVYPMSIPATLFVWYFWQKKKQRSGVLWDTPSPPEVVRAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHANFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANSRTDRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLKELLIPDADGQRTPQDNQLAYVVIGLLFMILTVAANEMGLLETTKKNLGIGHVVAENHHHATMLDIDLHPASAWTLYAVATTIITPMMRHTIENTTANISLTAIANQAAILMGLDKGRPISKMDIGVPLLALGCYSQVNPLTLTAAVLMLVAHYAIIGPGLQAKATREAQKRTAAGLMKNPTVDGIAAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCATGNIVSAVNMTSRMLLNRFTMAHRKPTYERDVDLGAGTRHVAVEPEIANLDIIGQRIENIKNEHKSTWHYDEDNPYKTWAYHGTYEVKPSGSASSMVNGVVRLLTKPWDVIPMVTQIAMTDTTPFGQQRVFKEKVDTRTPRPKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERALDWLEKHGVERLKRMAISGDDCVVKPTDDRFATALTALNDMGKVRKDIPQCEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWADVPYLGKREDQWCGSLIGLAARATWATNIQVALNQVRRLIGNENYLDYMTSMKRFKNESDPEGALW

SEQ ID NO: 2717 - protein, 3292 aa, synthetic construct
  REGION 1..3292: note = derived and/or modified protein sequence (wt) from DENV-1__JQ922544__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSCEGAWKQIQKVEIWALRHPGFTVIALFLAHAIGTSITQKGIIFILLMLVTPSMAMRCVGIGNREFVEGLSGATWVDVVLEHGSCLHTMAQNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTTHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIEAEPPFGESYIVVGAGEKALKLSWFKKGSSIGKMFEATARGARRMAILGDTAWDFGSIGGVFTSVGKLVHQVFGTAYGVLFSGVSWIMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVEEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLISFFVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVNMGQPLNNDEDHAHWTEAKMLLDNINTPEGIIPALFEPERKKSAAVDGEYRLRGEARKTFVELMRRGDLPVWLSYKVASEGFQYSDRRWCFDGERNNQVLEENMDVEIWTKERERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTIITPMMRHTIENTTANISLTAIANQAAILMGLDKGWPISLMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAMGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDKLVGRARVSQGAGWSLRETACLGKSYAQMWQLMYFHRRDLRLAANAICSAVPVDWVPTSRTTWSIHAHHQWMTTEDMLSVWNKVWIEENPWMEDKTHVSSWEDVPYLGKREDQWCGSLIGLTARATWATNIQVAINQVRRLIGNENYLDYMTSMKRFKNESDPEGALW

SEQ ID NO: 2718 - protein, 3292 aa, synthetic construct
  REGION 1..3292: note = derived and/or modified protein sequence (wt) from DENV-1__JQ922546__SS-prME
SVAMLLMLLPTALAFHLTTRGGEPHMIVSKQERGKSLLFKTSAGVNMCTLIAMDLGELCEDTMTYKWPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIAIITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSIQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSYTQVCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFFLLIMGQLTWNDLFRLCIMVGANASDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLSPLCLSTTSQKTTWLPVLLGSFGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKASLLAVSGVYPMSIPATLFVWYFWQKKKQRSGVLWDTPSPPEVERAVLDDGIYRILQRGLLGRSQVGVGIFQDGVFHTMWHVTRGAVLMYQGKRLEPSWASVKKDLISYGGGWRFQGSWNTGEEVQVIAVEPGKNPKNVQTTPGIFKTPEGEVGAITLDFKPGTSGSPIVNREGKIVGLYGNGVVTTSGTYVSAIAQAKASQEGPLPEIEDEVFRKRNLTIMDLHPGSGKTRRYLPAIVREAMKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYVYMGQPLNNDEDHAHWTEAKMLLDHINTPEGIIPALFEPEREKSAAIDGEYRLRGEARKTFVELMRRGDLPVWLSYKVASEGFQYTDRRWCFDGERNNQVLEENMDVEIWMEEGEKKKIRPRWLEIEKYSDPLALREFKEFSAKRKSVLGDLKLEIGKLPQHLTIKARNALDNLVMLHNSEQGGKAYRHAMEELPDTIETLMRLGLIAVMTGGVTLFFLSGKGLGKTSNGLLCVMASSVLLWMASVEPHWIAASIILEFFLMVLLIPEPDRQRTPQDNQLAYVVIGLLFMILTVAANEMGLLETTKKDLGIGHVVAENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAPQIMKNQIVDGIVAVDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPTVTQIAMTDTTPFGQQRVFKEKVDTRTPKAKRGTAQIMEVTANWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAERVLNWLEKHGVERLKRMAISGDDCVVKPTDDRFATALTALNDMGKVRKDTPQWEPSKGWNDWQQVPFCSHHFHQLIMKDGREIVVPCRNQDELVGRARVSHGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSIIGLTARATWATNIQVAINQVRRLIGNENYLDYMTSMKRFKNESDPEGALW

SEQ ID NO: 2719 - protein, 3292 aa, synthetic construct
  REGION 1..3292: note = derived and/or modified protein sequence (wt) from DENV-1__JQ922545__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHTIGTSITQKGIIFILLMTGAPIMAMRCVGIGNRDFVEGLSGAPWVDVVLEHGSCLSNMAKNKPTLDIDFFKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQMSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATCLENIMWKQISNELNHILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTIAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLEKAAEVSWEEEAQHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGSDIATVLERSREPVIQLSRKTFDTEYQKTKNNDWDYVVTTDISEMGANFRADRVIDPRRCLKPVIPKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIEKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFILMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKIGHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWMWGFLFRNRPPRICTRDEFARKVRSSTANGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDSSNEAKIIELMRPEHALLATSIFKLTFQISVVRVQRPAKSGTVMECISRRDQKRSGQVGTYGLNTFTNMEVQLIRQMESEGIFSPSEMENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2720 - protein, 3292 aa, synthetic construct
  REGION 1..3292: note = derived and/or modified protein sequence (wt) from DENV-1__GU131887__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIRYEGTDAPCKIPFSTQDERGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAALTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2721 - protein, 3292 aa, synthetic construct
  REGION 1..3292: note = derived and/or modified protein sequence (wt) from DENV-1__GU131888__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTGWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGPMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNALIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2722 - protein, 3292 aa, synthetic construct
  REGION 1..3292: note = derived and/or modified protein sequence (wt) from DENV-1__GU131892__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2723 - protein, 3292 aa, synthetic construct
  REGION 1..3292: note = derived and/or modified protein sequence (wt) from DENV-1__GU131893__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRSHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLVWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2724 - protein, 3292 aa, synthetic construct
  REGION 1..3292: note = derived and/or modified protein sequence (wt) from DENV-1__GU131894__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWTPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2725 - protein, 3292 aa, synthetic construct
  REGION 1..3292: note = derived and/or modified protein sequence (wt) from DENV-1__GU131895__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLALKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2726 - protein, 3292 aa, synthetic construct
  REGION 1..3292: note = derived and/or modified protein sequence (wt) from DENV-1__GQ868632__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDEQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEREENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSFLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2727 - protein, 3292 aa, synthetic construct
  REGION 1..3292: note = derived and/or modified protein sequence (wt) from DENV-1__GQ868633__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEATKHAVSRGPAKLRWFVERNLVNPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWVSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFWSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2728 - protein, 3292 aa, synthetic construct
  REGION 1..3292: note = derived and/or modified protein sequence (wt) from DENV-1__GU131919__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANACDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2729 - protein, 3292 aa, synthetic construct
  REGION 1..3292: note = derived and/or modified protein sequence (wt) from DENV-1__GU131920__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDREKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2730 - protein, 3292 aa, synthetic construct
  REGION 1..3292: note = derived and/or modified protein sequence (wt) from DENV-1__GU131921__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPMTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVEKAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2731 - protein, 3292 aa, synthetic construct
  REGION 1..3292: note = derived and/or modified protein sequence (wt) from DENV-1__GQ868635__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVEKAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2732 - protein, 3292 aa, synthetic construct
  REGION 1..3292: note = derived and/or modified protein sequence (wt) from DENV-1__GQ868636__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGLGEVDSFSLGLLCISIMIEEVMRSRWSRKMLMAGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHHAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPERCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 2733 - protein, 3292 aa, synthetic construct
  REGION 1..3292: note = derived and/or modified protein sequence (wt) from DENV-1__GU131922__SS-prME
SVIMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2734 - protein, 3292 aa, synthetic construct
  REGION 1..3292: note = derived and/or modified protein sequence (wt) from DENV-1__GU131923__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTVVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGITQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGKRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHEAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2735 - protein, 3292 aa, synthetic construct
  REGION 1..3292: note = derived and/or modified protein sequence (wt) from DENV-1__GQ868637__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEREENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLIAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIDENPWMEDKTHISSWGDVPYLGKREDQWCGSLIGLTARATWATNIQVAINQVRRLIGNENYLDYMTSMKRFKNESDPEGALW

SEQ ID NO: 2736 - protein, 3292 aa, synthetic construct
  REGION 1..3292: note = derived and/or modified protein sequence (wt) from DENV-1__GQ868639__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLADFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2737 - protein, 3292 aa, synthetic construct
  REGION 1..3292: note = derived and/or modified protein sequence (wt) from DENV-1__GU131925__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2738 - protein, 3292 aa, synthetic construct
  REGION 1..3292: note = derived and/or modified protein sequence (wt) from DENV-1__GU131926__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGVNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2739 - protein, 3292 aa, synthetic construct
  REGION 1..3292: note = derived and/or modified protein sequence (wt) from DENV-1__FJ639669__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2740 - protein, 3293 aa, synthetic construct
  REGION 1..3293: note = derived and/or modified protein sequence (wt) from DENV-1__FJ639670__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGVSRKNLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWIASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSSNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2741 - protein, 3292 aa, synthetic construct
  REGION 1..3292: note = derived and/or modified protein sequence (wt) from DENV-1__FJ639671__SS-prME
SVTMLLMLMPTALAFHLTTRGGEPHMIVSKQERGKSLLFKTSAGVNMCTLIAMDLGELCEDTLTYKCPRITEVEPDDVDCWCNTTDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDGKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWRQISNELNHILLENDMKFTVVVGDVVGILAQGKKMIRPQPMEHKYSWKSWGKAKIIGADVQNTTFIIDGPNTSECPDDQRAWNIWEVEDYGFGIFTTNIWLKLRDSYTQVCDHRLMSAAIKDSRAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPETIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2742 - protein, 3292 aa, synthetic construct
  REGION 1..3292: note = derived and/or modified protein sequence (wt) from DENV-1__JN819423__SS-prME
SVTMLLMLMPTALAFHLTTRGGEPHMIVSKQERGKSLLFKTSAGVNMCTLIAMDLGELCEDTLTYKCPRITEVEPDDVDCWCNTTDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDGKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWRQISNELNHILLENDMKFTVVVGDVVGILAQGKKMIRPQPMEHKYSWKSWGKAKIIGADVQNTTFIIDGPNTSECPDDQRAWNIWEVEDYGFGIFTTNIWLKLRDSYTQVCDHRLMSAAIKDSRAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPETIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHQQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2743 - protein, 3292 aa, synthetic construct
  REGION 1..3292: note = derived and/or modified protein sequence (wt) from DENV-1__FJ639672__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGISSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDAFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2744 - protein, 3292 aa, synthetic construct
  REGION 1..3292: note = derived and/or modified protein sequence (wt) from DENV-1__FJ639673__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2745 - protein, 3292 aa, synthetic construct
  REGION 1..3292: note = derived and/or modified protein sequence (wt) from DENV-1__FJ639674__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSMSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPVKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2746 - protein, 3292 aa, synthetic construct
  REGION 1..3292: note = derived and/or modified protein sequence (wt) from DENV-1__FJ639675__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGLFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSSAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2747 - protein, 3292 aa, synthetic construct
  REGION 1..3292: note = derived and/or modified protein sequence (wt) from DENV-1__FJ639676__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHAGLGLETRAETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFFIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGILEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDFMTSMKRFKNESDTEGALW

SEQ ID NO: 2748 - protein, 3292 aa, synthetic construct
  REGION 1..3292: note = derived and/or modified protein sequence (wt) from DENV-1__FJ639677__SS-prME
SVTMLLMLMPTALAFHLTTRGGEPHMIVSKQERGKSLLFKTSAGVNMCTLIAMDLGELCEDTMTYKCPRVTEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAMGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLKGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRSKKPRICTREEFIRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2749 - protein, 3292 aa, synthetic construct
  REGION 1..3292: note = derived and/or modified protein sequence (wt) from DENV-1__GQ868618__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2750 - protein, 3292 aa, synthetic construct
  REGION 1..3292: note = derived and/or modified protein sequence (wt) from DENV-1__GQ868619__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLVVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPIILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVMLFFLSGRGLGKTSIGLLCVMASSGLLWMASVEPHWIAASIILEFFLMVLLIPEPDRQRTPQDNQLAYVVMGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2751 - protein, 3292 aa, synthetic construct
  REGION 1..3292: note = derived and/or modified protein sequence (wt) from DENV-1__FJ639678__SS-prME
SVTMLLMLMPTALAFHLTTRGGEPHMIVSKQERGKALLFKTSAGVNMCTLIAMDLGELCEDTMTYKCPRITEVEPDDVDCWCNATDTWVTYGTCPQTGEHRRDRRSVALAPHVGLGLETRAETWMSSEGAWKQIQRVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEYKYSWKSWGKAKIIGADIQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFLWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGQERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKQGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLRNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2752 - protein, 3292 aa, synthetic construct
  REGION 1..3292: note = derived and/or modified protein sequence (wt) from DENV-1__FJ639679__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAARVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2753 - protein, 3292 aa, synthetic construct
  REGION 1..3292: note = derived and/or modified protein sequence (wt) from DENV-1__FJ850069__SS-prME
SVTMLLMLMPTALAFHLTTRGGEPHMIVGKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWVTLLSLTFIKTTFSLHYAWKTMAMVLSIVSLLPLCLSTTSQKTTWLPVLLGSLGCKPLTMFFIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGILEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAGWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDTEGALW

SEQ ID NO: 2754 - protein, 3292 aa, synthetic construct
  REGION 1..3292: note = derived and/or modified protein sequence (wt) from DENV-1__FJ639680__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHNHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2755 - protein, 3292 aa, synthetic construct
  REGION 1..3292: note = derived and/or modified protein sequence (wt) from DENV-1__FJ639682__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKTLKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVLSGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGIPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2756 - protein, 3292 aa, synthetic construct
  REGION 1..3292: note = derived and/or modified protein sequence (wt) from DENV-1__JQ287664__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFFIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRKYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGILEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPFDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDTEGALW

SEQ ID NO: 2757 - protein, 3292 aa, synthetic construct
  REGION 1..3292: note = derived and/or modified protein sequence (wt) from DENV-1__FJ639683__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSLVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2758 - protein, 3292 aa, synthetic construct
  REGION 1..3292: note = derived and/or modified protein sequence (wt) from DENV-1__FJ639684__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESVPEGALW

SEQ ID NO: 2759 - protein, 3292 aa, synthetic construct
  REGION 1..3292: note = derived and/or modified protein sequence (wt) from DENV-1__FJ639685__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSVMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPILAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2760 - protein, 3292 aa, synthetic construct
  REGION 1..3292: note = derived and/or modified protein sequence (wt) from DENV-1__FJ639686__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIRYEGTDAPCKIPFSTQDERGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2761 - protein, 3292 aa, synthetic construct
  REGION 1..3292: note = derived and/or modified protein sequence (wt) from DENV-1__FJ639687__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLKETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2762 - protein, 3292 aa, synthetic construct
  REGION 1..3292: note = derived and/or modified protein sequence (wt) from DENV-1__FJ639688__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNVWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPTSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQMAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAIYQVRRLIGNENYLDYMTSMKRFKNESDPEGALW

SEQ ID NO: 2763 - protein, 3292 aa, synthetic construct
  REGION 1..3292: note = derived and/or modified protein sequence (wt) from DENV-1__FJ639689__SS-prME
SVTMLLMLMPTALAFHLTIRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMTEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMILKLLTDFQPHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGVMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2764 - protein, 3292 aa, synthetic construct
  REGION 1..3292: note = derived and/or modified protein sequence (wt) from DENV-1__FJ639690__SS-prME
SVTMLLMLMPTALAFHLTIRGGEPHMIVSKQERGKSLLFKTSAGVNMCTLIAMDLGELCEDTMTYKCPRITEAEPDDVDCWCNATDTWVTYGTCSQIGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMTEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMILKLLTDFQPHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2765 - protein, 3292 aa, synthetic construct
  REGION 1..3292: note = derived and/or modified protein sequence (wt) from DENV-1__FJ639691__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERTLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDLEGALW

SEQ ID NO: 2766 - protein, 3292 aa, synthetic construct
  REGION 1..3292: note = derived and/or modified protein sequence (wt) from DENV-1__FJ639692__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNALIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGITEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2767 - protein, 3292 aa, synthetic construct
  REGION 1..3292: note = derived and/or modified protein sequence (wt) from DENV-1__FJ639693__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLAVGFQTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAGPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2768 - protein, 3292 aa, synthetic construct
  REGION 1..3292: note = derived and/or modified protein sequence (wt) from DENV-1__FJ639694__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISNWGDVPYLGKREDQWCGSLIGLTARATWATNIQVAINQVRRLIGNENYLDYMTSMKRFKNESDPEGALW

SEQ ID NO: 2769 - protein, 3292 aa, synthetic construct
  REGION 1..3292: note = derived and/or modified protein sequence (wt) from DENV-1__FJ639695__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRSHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLVWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2770 - protein, 3292 aa, synthetic construct
  REGION 1..3292: note = derived and/or modified protein sequence (wt) from DENV-1__FJ639696__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDLEGALW

SEQ ID NO: 2771 - protein, 3292 aa, synthetic construct
  REGION 1..3292: note = derived and/or modified protein sequence (wt) from DENV-1__HM181937__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNIEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2772 - protein, 3292 aa, synthetic construct
  REGION 1..3292: note = derived and/or modified protein sequence (wt) from DENV-1__HM181939__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLANSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2773 - protein, 3292 aa, synthetic construct
  REGION 1..3292: note = derived and/or modified protein sequence (wt) from DENV-1__HM181942__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLANSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2774 - protein, 3292 aa, synthetic construct
  REGION 1..3292: note = derived and/or modified protein sequence (wt) from DENV-1__HM488255__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGRGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2775 - protein, 3292 aa, synthetic construct
  REGION 1..3292: note = derived and/or modified protein sequence (wt) from DENV-1__HM181944__SS-prME
SVTMLLMLMPTALAFHLTTRGGEPHMIVSKQERGKSLLFKTSAGVNMCTLIAMDLGELCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLANSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2776 - protein, 3292 aa, synthetic construct
  REGION 1..3292: note = derived and/or modified protein sequence (wt) from DENV-1__HM181946__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIRYEGTDAPCKIPFSTQDERGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2777 - protein, 3292 aa, synthetic construct
  REGION 1..3292: note = derived and/or modified protein sequence (wt) from DENV-1__HM181948__SS-prME
SVTMLLMLMPTALAFHLTTRGGEPHMIVSKQERGKSLLFKTSAGVNMCTLIAMDLGELCEDTMTYKCPRITEVEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2778 - protein, 3292 aa, synthetic construct
  REGION 1..3292: note = derived and/or modified protein sequence (wt) from DENV-1__HM181949__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTGHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGRGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2779 - protein, 3292 aa, synthetic construct
  REGION 1..3292: note = derived and/or modified protein sequence (wt) from DENV-1__HM181950__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYSLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2780 - protein, 3292 aa, synthetic construct
  REGION 1..3292: note = derived and/or modified protein sequence (wt) from DENV-1__HM181952__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLAKASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIVGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 2781 - protein, 3292 aa, synthetic construct
  REGION 1..3292: note = derived and/or modified protein sequence (wt) from DENV-1__HM181953__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKLEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2782 - protein, 3292 aa, synthetic construct
  REGION 1..3292: note = derived and/or modified protein sequence (wt) from DENV-1__KF921933__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSKCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRLGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDGRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2783 - protein, 3292 aa, synthetic construct
  REGION 1..3292: note = derived and/or modified protein sequence (wt) from DENV-1__HM181954__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTPGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2784 - protein, 3292 aa, synthetic construct
  REGION 1..3292: note = derived and/or modified protein sequence (wt) from DENV-1__HM181955__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLVVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2785 - protein, 3292 aa, synthetic construct
  REGION 1..3292: note = derived and/or modified protein sequence (wt) from DENV-1__HM181959__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKVIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLVVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2786 - protein, 3292 aa, synthetic construct
  REGION 1..3292: note = derived and/or modified protein sequence (wt) from DENV-1__JF937651__SS-prME
SVTMLLMLMPTALAFHLTTRGGEPHMILSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANACDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMKHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTGKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPKGALW

SEQ ID NO: 2787 - protein, 3292 aa, synthetic construct
  REGION 1..3292: note = derived and/or modified protein sequence (wt) from DENV-1__GU131956__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGTIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2788 - protein, 3292 aa, synthetic construct
  REGION 1..3292: note = derived and/or modified protein sequence (wt) from DENV-1__GU131958__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW
